US011345925B2

(12) United States Patent
Barry et al.

(10) Patent No.: US 11,345,925 B2
(45) Date of Patent: May 31, 2022

(54) INSECTICIDAL PROTEINS FROM PLANTS AND METHODS FOR THEIR USE

(71) Applicant: PIONEER HI-BRED INTERNATIONAL, INC., Johnston, IA (US)

(72) Inventors: Jennifer Kara Barry, Ames, IA (US); James J English, San Ramon, CA (US); Kevin A Fengler, Clive, IA (US); Zhenglin Hou, Ankeny, IA (US); Lu Liu, Palo Alto, CA (US); Eric Schepers, Port Deposit, MD (US); Jeffrey Sopa, Rising Sun, MD (US); Ingrid Udranszky, Mountain View, CA (US)

(73) Assignee: PIONEER HI-BRED INTERNATIONAL, INC.

( * ) Notice: Subject to any disclaimer, the term of this patent is extended or adjusted under 35 U.S.C. 154(b) by 0 days.

(21) Appl. No.: 16/342,143

(22) PCT Filed: Oct. 13, 2017

(86) PCT No.: PCT/US2017/056517
§ 371 (c)(1),
(2) Date: Apr. 15, 2019

(87) PCT Pub. No.: WO2018/075350
PCT Pub. Date: Apr. 26, 2018

(65) Prior Publication Data
US 2019/0256563 A1    Aug. 22, 2019

Related U.S. Application Data

(60) Provisional application No. 62/411,318, filed on Oct. 21, 2016.

(51) Int. Cl.
*C12N 15/82* (2006.01)
*C07K 14/415* (2006.01)
*A01N 65/04* (2009.01)

(52) U.S. Cl.
CPC .......... *C12N 15/8286* (2013.01); *A01N 65/04* (2013.01); *C07K 14/415* (2013.01); *Y02A 40/146* (2018.01)

(58) Field of Classification Search
CPC ..................... C12N 15/8286; C07K 14/415
See application file for complete search history.

(56) References Cited

U.S. PATENT DOCUMENTS

| 8,513,492 B2 | 8/2013 | English et al. |
| 10,457,957 B2 * | 10/2019 | Abad ................. C12N 15/8286 |
| 2016/0031949 A1 | 2/2016 | Abad et al. |
| 2016/0108428 A1 | 4/2016 | Baum et al. |

FOREIGN PATENT DOCUMENTS

WO    2016144686 A1    9/2016

OTHER PUBLICATIONS

Friedberg (Automated protein function prediction—the genomic challenge. Brief. Bioinformatics. 7:225-242, 2006) (Year: 2006).*
Kumar et al. (Analysis of Mutations in the Pore-Forming Region Essential for Insecticidal Activity of a Bacillus thuringiensis d-Endotoxin. Journal of Bacteriology, p. 6103-6107, Oct. 1999) (Year: 1999).*
Maeder et al. (The Methanosarcina barkeri Genome: Comparative Analysis with Methanosarcina acetivorans and Methanosarcina mazei Reveals Extensive Rearrangement within Methanosarcinal Genomes. Journal of Bacteriology, p. 7922-7931, 2006) (Year: 2006).*
Tassel Ferns and Clubmosses—Australian Plant Information_2005 (Year: 2005).*
Yuan, Ling et al.; "Laboratory-Directed Protein Evolution," Microbiology Molecular Biology Reviews, (Mar. 9, 2005), vol. 69, Iss. 3, pp. 373-392.
International Search Report and Written Opinion for International Application PCT/US2017/056517, dated Jan. 18, 2018.

* cited by examiner

*Primary Examiner* — Bratislav Stankovic
*Assistant Examiner* — Wayne Zhong

(57) ABSTRACT

Compositions and methods for controlling pests are provided. The methods involve transforming organisms with a nucleic acid sequence encoding an insecticidal protein. In particular, the nucleic acid sequences are useful for preparing plants and microorganisms that possess insecticidal activity. Thus, transformed bacteria, plants, plant cells, plant tissues and seeds are provided. Compositions are insecticidal nucleic acids and proteins of bacterial species. The sequences find use in the construction of expression vectors for subsequent transformation into organisms of interest including plants, as probes for the isolation of other homologous (or partially homologous) genes. The pesticidal proteins find use in controlling, inhibiting growth or killing Lepidopteran, Coleopteran, Dipteran, fungal, Hemipteran and nematode pest populations and for producing compositions with insecticidal activity.

6 Claims, 32 Drawing Sheets

Specification includes a Sequence Listing.

Fig. 1A

```
                    1                                                  50
IPD080Aa   (1)  MSIQIDIEPGNVRVSGSSRHIITDADVRTFGLNDNALKNAVLAHLGRRPN
IPD080Abj  (1)  MSIQIDIEPGNVRVSGSSRHIITDADVRTFGLNDNALKNAVLAHLGRRPN
IPD080Ai   (1)  MSIQIDIEPGNVRVSGSSRHIITDADVRTFGLNDNALKNAVLAHLGRRPN
IPD080Acf  (1)  MSIQIDIEPGNVRVSGSSRHIITDADVRTFGLNDNALKNAVLAHFERRPN
IPD080An   (1)  MSIQIDIEPGNVRVSGSSRHIITDADVRTFGLNDNALKNAVLAHFERRPN
IPD080Acy  (1)  MSIQIDIEPGRVRVSGSSRHIITDADVRTFGLNDNALKNAVLAHLGRRPN
IPD080Adb  (1)  MSIQIDIEPGSVRVSGSSRHIITDADVRTFGLNDNALKNAVLAHLGRRPN
IPD080Adg  (1)  MSIQIDIEPGSVRVSGSSRHIITDADVRTFGLNDNALKNAVLAHLGRRPN
IPD080Ada  (1)  MSIQIDIEPGSVRVSGSSRHIITDADVRTFGLNDNALKNAVLAHFGRRPN
IPD080Adh  (1)  MSIQIDIEPGSVRVSGSSRHIITDADVRTFGLNDNALKNAVLAHFGRRPN
IPD080Acz  (1)  MSIQIDIEPGTVRVSGSSRHIITDADVRTFGLNDNALKNAVLAHLGRRPN
IPD080Ade  (1)  MSIQIDIEPGSVRVSGSSRHIITDADVRTFGLNDNALKNAVLAHFGRRPN
IPD080Adc  (1)  MSIQIDIEPGNVRVSGSSWHIITDADVRTFGLNDNALKNAVLAHFGRRPN
IPD080Adf  (1)  MSIQIDIEPGNVRVSGSSRHIITDADVRTFGLNDNALKNAVLAHLGRRPN
IPD080Adi  (1)  MSIQIDIEPGSVRVSGSSRHIITDADVRTFGLNDNALKNAVLAHFGRRPN
IPD080Adj  (1)  MSIQIDIEPGSVRVSGSSRHIITDADVRTFGLNDNALKNAVLAHFGRRPN
IPD080Adk  (1)  MSIQIDIEPGSVRVSGSSRHIITDADVRTFGLNDNALKNAVLAHFGRRPN
IPD080Bf   (1)  MSIEIDIEPGRVRVSGSSRHIITDADVGTFGLHDNALKNAVLAHFGRRPN
IPD080Bg   (1)  MSIEIDIEPGRVWVSGSSRHIITDADVGTFGLHDNALKNAVLAHFGRRPN
IPD080Bi   (1)  MSIEIDIEPGRVRVSGSSRHIITDADVGTFGLHDNALKNAVLAHFGRRPN
IPD080Bh   (1)  MSIEIDIEPGRVRVSGSSRHIITDADVGTFGLHDNALKNAVLAHFGRRPN
IPD080Bj   (1)  MSIEIDIEPGRVRVSGSSRHIITDADVGTFGLHDNALKNAVLAHFGRRPN
IPD080Bk   (1)  MSIEIDIEPGSVRVSGSSRHIITDADVGTFGLHDNALKNAVLAHNGRRPN
IPD080Bn   (1)  MSIEIDIEPGSVRVSGSSRHIITDADVGTFGLHDNALKNAVLAHNGRRPN
IPD080Bm   (1)  MSIEIDIEPGSVRVSGSSRHIITDADVGTFGLHDNALKNAVLAHNGRRPN
IPD080Bl   (1)  MSIEIDIEPGSVRVSGSSRHIITDADVGTFGLHDDALKNAVLAHNGRRPN
IPD080Bo   (1)  MSIEIDIEPGSVRVSGSSRHIITDADVGTFGLHDNALKNAVLAHNGRRPN
IPD080Aah  (1)  MSIQIDIEPGSVRVSGSSRHIITDGDVRTFGLNDNALKNAVLAHFERRPN
IPD080Abp  (1)  MSILIDIKPGSVRVSGSSRHIITDADVRTFGLNDNALNNAVLAHLGRRPN
IPD080Abq  (1)  MSIQIDIEPGNVRVSGSSRHIITDADVRTFGLNDNALKNAVLAHLGRRPN
IPD080Abw  (1)  MSIQIDIEPGNVRVSGSSQHIITDADVRTFGLNDNALKNAVQAHFERRPN
IPD080Abx  (1)  MSIQIDIEPGNVRVSGSSQHIITDADVRTFGLNDNALKNAVQAHFERRPN
IPD080Abi  (1)  MSIQIDIEPGSVRVSGSSRHIITDGDVSTFGLNDNALKNAVLAHFERRPN
IPD080Ach  (1)  MSIQIDIEPGSVRVSGSSRHIITDGDVRTFGLNDNALKNAVLAHFERRPN
IPD080Ae   (1)  MSIQIDIEPGSVRVSGSSRHIITDGDVRTFGLNDNALKNAVLAHFERRPN
IPD080At   (1)  MAFVIDIEPGSVRVSGSSRHIITDGDVRTFGLNDNALKNAVLAHFERRPN
IPD080Acu  (1)  MSIQIDIEPGNVRVSGSSRHIITDADVRTFGLNDNALKNAVLAHFERRPN
IPD080Af   (1)  MSIQIDIEPGNVRVSGSSRHIITDADVRTFGLNDNALKNAVLAHFERRPN
IPD080Aaa  (1)  MSIQIDIEPGNVRVSGSSQHIITDADVRTFGLNDNALKNAVQAHFERRPN
IPD080Ar   (1)  MSIQIDIEPGNVRVSGSSRHIITDADVRTFGLNDNALKNAVLAHFERRPN
IPD080Ax   (1)  MAFLIDIEPGNVRVSGSSQHIITDADVRTFGLNDNALKNAVQAHFERRPN
IPD080Abh  (1)  MSIQIDIEPGNVRVSGSSRHIITDADVRTFGLNDNALKNAVLAHFERRPN
IPD080Acv  (1)  MSIQIDIEPGNVRVSGSSRHIITDADVRTFGLNDNALKNAVQAHFERRPN
IPD080Acx  (1)  MSIQIDIEPGNVRVSGSSRHIITDADVRTFGLNDNALKNAVQAHFERRPN
IPD080Acw  (1)  MSIQIDIEPGNVRVSGSSRHIITDADVRTFGLNDNALKNAVQAHFERRPN
IPD080Acr  (1)  MSIQIDIEPGNVRVSGSSRHIITDADVRTFGLNDNALKNAVLAHFERRPN
IPD080Acs  (1)  MSIQIDIEPGNVRVSGSSRHIITDADVRTFGLNDNALKNAVLAHFERRPN
IPD080Act  (1)  MSIQIDIEPGNVRVSGSSRHIITDADVRTFGLNDNALKNAVLAHFERRPN
```

Fig. 1B

| | | |
|---|---|---|
| IPD080Aaf | (1) | MSIQIDIEPGNVRVSGSSRHIITDADVRTFGLNDNALKNAVLAHFERRPN |
| IPD080Aak | (1) | MSIQIDIEPGNVRVSGSSRHIITDADVRTFGLNDNALKNAVLAHFERRPN |
| IPD080Ay | (1) | MSIQIDIEPGNVRVSGSSRHIITDADVRTFGLNDNALKNAVLAHFERRPN |
| IPD080Abt | (1) | MSILIDIEPGNVRMSGSSRLIITDADVRTFGLNDNALKNAVLAHFERRPN |
| IPD080Abu | (1) | MSIQIDIEPGNVRVSGSSRHIITDADVRTFGLNDNALKNAVLAHFERRPN |
| IPD080Abv | (1) | MSIQIDIEPGNVRVSGSSRHIITDADVRTFGLNDNALKNAVLAHFERRPN |
| IPD080Aad | (1) | MSIQIDIEPGNVRVSGSSRHIITDADVRTFGLNDNALKNAVLAHFERRPN |
| IPD080Au | (1) | MSIQIDIEPGNVRVSGSSRHIITDADVRTFGLNDNALKNAVLAHFERRPN |
| IPD080Acb | (1) | MSIQIDIEPGSVRVSGSSRHIITDGDVRTFGLNDNALKNAVLAHFERRPN |
| IPD080Acc | (1) | MSIQIDIEPGSVRVSGSSRHIITDGDVRTFGLNDNALKNAVLAHFERRPN |
| IPD080Bb | (1) | MSIQIDIEPGNVQVSGSSRHIITDADVRTFGLNDNALKNAVLAHFERRPN |
| IPD080Be | (1) | MSIQIDIEPGNVRVSGSSRHIITDADVRTFGLNDNALKNAVLAHFERRPN |
| IPD080Aav | (1) | MSIQIDIEPGNVRVSGSSRHIITDADVRTFGLNDNALKNAVLAHFERRPN |
| IPD080Aab | (1) | MSIQIDIEPGNVRVSGSSRHIITDADVRTFGLNDNALKNAVQAHFERRPN |
| IPD080Aal | (1) | MSIQIDIEPGNVRVSGSSQHIITDADVRTFGLNDNALKNAVQAHFERRPN |
| IPD080Aai | (1) | MSIQIDIEPGNVRVSGSSRHIITDADVRTFGLNDNALKNAVLAHFERRPN |
| IPD080Aaj | (1) | MSIQIDIEPGNVRVSGSSRHIITDADVRTFGLNDNALKNAVLAHFERRPN |
| IPD080Aao | (1) | MSIQIDIEPGNVRVSGSSQHIITDADVRTFGLNDNALKNAVQAHFERRPN |
| IPD080Aar | (1) | MSIQIDIEPGNVRVSGSSQHIITDADVRTFGLNDNALKNALQAHFERRPN |
| IPD080Abc | (1) | MSIQIDIEPGNVRVSGSSQHIITDADVRTFGLNDNALKNAVQAHFERRPN |
| IPD080Abd | (1) | MSIQIDIEPGNVRVSGSSQHIITDADVRTFGLNDNALKNAVQAHFERRPN |
| IPD080Acg | (1) | MSIQIDIEPGSVRVSGSSQHIITDADVRTFGLNDNALKNAVQAHFERRPN |
| IPD080Ab | (1) | MSIQIDIEPGNVRVSGSSRHIITDADVRTFGLNDNALKNAVLAHFERRPN |
| IPD080Aby | (1) | MSIQIDIEPGNVRVSGSSRHIITDADVRTFGLNDNALKNAVQAHFERRPN |
| IPD080Abz | (1) | MSIQIDIEPGNVRVSGSSRHIITDADVRTFGLNDNALKNAVQAHFERRPN |
| IPD080Aaq | (1) | MAFVIDIEPGNVRVSGSSRHIITDADVRTFGLNDNALKNAVQAHFERRPN |
| IPD080Aas | (1) | MAFVIDIEPGNVRVSGSSRHIITDADVRTFGLNDNALKNAVLAHFERRPN |
| IPD080Ad | (1) | MAFVIDIEPGNVRVSGSSRHIITDADVRTFGLNDNALKNAVLAHFERRPN |
| IPD080Ba | (1) | MAFVIDIEPGNVRVSGSSQHIITDADVRTFGLNDNALKNAVQAHFERRPN |
| IPD080Bc | (1) | MAFVINIEPGNVRVSGSSQHIITDADVRTFGLNDNALKNAVQAHFERRPN |
| IPD080Bd | (1) | MAFLIDIEPGNVRVSGSSQHIITDADVRTFGLNDNALKNAVQAHFERRPN |
| IPD080Aci | (1) | MSIQIDIEPGNVRVSGSSQHIITDADVRTFGLNDNALKNAVQAHFERRPN |
| IPD080Acj | (1) | MSIQIDIEPGNVRVSGSSQHIITDADVRTFGLNDNALKNAVQAHFERRPN |
| IPD080Aap | (1) | MSIQIDIEPGNVRVSGSSRHIITDADVRTFGLNDNALKNAVQAHFERRPN |
| IPD080Abm | (1) | MSIQIDIEPGNVRVSGSSRHIITDADVRTFGLNDNALKNAVQAHFERRPN |
| IPD080Abn | (1) | MSIQIDIEPGNVRVSGSSRHIITDADVRTFGLNDNALKNAVQAHFERRPN |
| IPD080Abo | (1) | MSIQIDIEPGNVRVSGSSRHIITDADVRTFGLNDNALKNAVQAHFERRPN |
| IPD080Ao | (1) | MSIQIDIEPGNVRVSGSSRHIITDADVRTFGLNDNALKNAVQAHFERRPN |
| IPD080Aac | (1) | MSIQIDIEPGNVRVSGSSQHIITDADVRTFGLNDNALKNAVQAHFERRPN |
| IPD080Aae | (1) | MSIQIDIEPGNVRVSGSSQRIITDADVRTFGLNDNALKNAVQAHFERRPN |
| IPD080Aw | (1) | MSIQIEIEPGNVRVSGSSRHIITDADVRTFGLNDNALKNAVQAHFERRPN |
| IPD080Az | (1) | MSIQIDIEPGNVRVSGSSRHIITDADVRTFGLNDNALKNAVQAHFERRPN |
| IPD080Acd | (1) | MSIQIDIEPGNVRVSGSSQHIITDADVRTFGLNDNALKNAVQAHFERRPN |
| IPD080Ace | (1) | MSIQIDIEPGNVRVSGSSQHIITDADVRTFGLNDNALKNAVQAHFERRPN |
| IPD080Aam | (1) | MAFVIDIEPGSVRVSGSSRHIITDADVRTFGLNDNALKNAVQAHFERRPN |
| IPD080Aan | (1) | MAFLIDIEPGSVRVSGSSRHIITDADVRTFGLNDNALKNAVQAHFERRPN |
| IPD080Acq | (1) | MAFVIDIEPGNVRVSGSSRHIITDADVRTFGLNDNALKNAVQAHFERRPN |
| IPD080Aba | (1) | MSIQIDIEPGNVRVSGSSRHIITDADVRTFGLNDNALKNAVLAHFERRPN |
| IPD080Acn | (1) | MSIQIDIEPGNVRVSGSSRHIITDADVRTFGLNDNALKNAVLAHFERRPN |

Fig. 1C

| | | |
|---|---|---|
| IPD080Aco | (1) | MSIQIDIEPGNVRVSGSSRHIITDADVRTFGLNDNALKNAVLAHFERRPN |
| IPD080Acp | (1) | MSIQIDIEPGNVRVSGSSRHIITDADVRTFGLNDNALKNAVLAHFERRPN |
| IPD080Aca | (1) | MSIQIDIEPGNVRVSGSSRHIITDADVRTFGLNDNALKNAVLAHFERRPN |
| IPD080Ah | (1) | MSIQIDIEPGNVRVSGSSRHIITDADVRTFGLNDNALKNAVLAHFERRPN |
| IPD080Aag | (1) | MSIQIDIEPGNVRVSGSSRHIITDADVRTFGLNDNALKNAVQAHFERRPN |
| IPD080Ac | (1) | MAFVIDIEPGNVRVSGSSRHIITDADVRTFGLNDNALKNAVQAHFERRPN |
| IPD080Av | (1) | MSIQIDIEPGNVRVSGSSRHIITDADVRTFGLNDNALKNAVQAHFERRPN |
| IPD080Abk | (1) | MSIQIDIEPGNVRVSGSSRHIITDADVRTFGLNDNALKNAVLAHFERRPN |
| IPD080Abl | (1) | MSIQIDIEPGNVRVSGSSRHIITDADVRTFGLNDNALKNAVLAHFERRPN |
| IPD080Aq | (1) | MSIQIDIEPGNVRVSGSSRHIITDADVRTFGLNDNALKNAVLAHFERRPN |
| IPD080Abr | (1) | MSIQIDIEPGSVRVSGSSRHIITDGDVRTFGLNDNALKNAVLAHFERRPN |
| IPD080Abs | (1) | MSIQIDIEPGSVRASGSSRHIITDGDVRTFGLNDNALKNAVLAHFERRPN |
| IPD080Am | (1) | MSIQIDIEPGNVRVSGSSRHIITDADVRTFGLNDNALKNAVLAHFERRPN |
| IPD080Aax | (1) | MSIQIDIEPGNVRVSGSSRHIITDADVRTFGLNDNALKNAVLAHFERRPN |
| IPD080Aay | (1) | MSIQIDIEPGNVRVSGSSRHIITDADVRTFGLNDNALKNAVLAHFERRPN |
| IPD080As | (1) | MSIQIDIEPGNVRVSGSSRHIITDADVRTFGLNDNALKNAVLAHFERRPN |
| IPD080Ag | (1) | MSIQIDIEPGNVRVSGSSRHIITDADVRTFGLNDNALKNAVLAHFERRPN |
| IPD080Abe | (1) | MSIQIDIEPGSVRVSGSSRHIITDGDVRTFGLNDNALKNAVLAHFERRPN |
| IPD080Abf | (1) | MSIQIDIEPGSVRVSGSSRHIITDGDVRTFGLNDNALKNAVLAHFERRPN |
| IPD080Abg | (1) | MSIQIDIEPGSVRVSGSSRHIITDGDVRTFGLNDNALKNAVLAHFERRPN |
| IPD080Acl | (1) | MSIQIDIQPGNVRVSGSSRHIITDADVRTFGLNDNALKNAVQAHFERRPN |
| IPD080Acm | (1) | MSIQIDIQPGNVRVSGSSRHIITDADVRTFGLNDNALKNAVQAHFERRPN |
| IPD080Ak | (1) | MSIQIDIEPGNVRVSGSSQHIITDADVRTFGLNDNALKNAVQAHFERRPN |
| IPD080Al | (1) | MSIQIDIEPGNVRVSGSSQHIITDADVRTFGLNDNALKNAVLAHFERRPN |
| IPD080Ap | (1) | MAFVIDIEPGNVRVSGSSRHIITDADVRTFGLNDNALKNAVLAHFERRPN |
| IPD080Aat | (1) | MSIQIDIEPGNVRVSGSSRHIITDADVRTFGLNDNALKNAVLAHFERRPN |
| IPD080Aau | (1) | MSIQIDIEPGNVRVGGSSRHIITDADVRTFGLNDNALKNAVLAHFERRPN |
| IPD080Aaw | (1) | MSIQIDIEPGNVRVSGSSRHIITDADVRTFGLNDNALKNAVLAHFERRPN |
| IPD080Aaz | (1) | MSIQIDIEPGNVRVSGSSRHIITDADVRTFGLNDNALKNAVLAHFERRPN |
| IPD080Ack | (1) | MSIQIDIEPGNVRVSGSSRHIITDADVRTFGLNNNALKNAVLAHFERRPN |
| IPD080Aj | (1) | MSIQIDIEPGNVRVSGSSRHIITDADVRTFGLNDNALKNAVLAHFERRPN |

| | | 51                                              100 |
|---|---|---|
| IPD080Aa | (51) | DAFLRSPTPWGDLYSTYGWPQVQTVLAVRSSQILEETSRPVMLAYQNFVN |
| IPD080Abj | (51) | DAFLRSPTPWGDLYTSYGWPQVQTVLAVRSSQILEETSRPVMLAYQNFVD |
| IPD080Ai | (51) | DAFLRSPTPWGDLYTSYGWPQVQTVLAVRSSQILEETSRPVMLAYQNFVN |
| IPD080Acf | (51) | DAFLRSPTPWGDLYTTYGWPQVQTVLAVRSSQILEETSRPVMLDYRNFVN |
| IPD080An | (51) | DAFLRSPTPWGDLYTTYGWPQVQTVLAVRSSQILEETSRPVMLDYRNFVN |
| IPD080Acy | (51) | DAFLRSPTPWGDLYSTYGWPQVQTVLAVRSSQILEETTRPVMLAYQNFVN |
| IPD080Adb | (51) | DAFLRSPTPWGDLYSTYGWPQVQTVLAVRSSQILEETTRPVMLAYQNFVN |
| IPD080Adg | (51) | DAFLRSPTPWGDLYSTYGWPQVQTVLAVRSSQILEETTRPVMLAYQNFVN |
| IPD080Ada | (51) | DAFLRSPTPWGDLYSTYGWPQVQTVLAVRSSQILEETTRPVMLAYQNFVN |
| IPD080Adh | (51) | DAFLRSPTPWGDLYSTYGWPQVQTVLAVRSSQILEETSRPVMLAYQNFVN |
| IPD080Acz | (51) | DAFLRSPTPWGDLYSTYGWPQVQTVLAVRSSQILEETSRPVMLAYQNFVN |
| IPD080Ade | (51) | DAFLRSPTPWGDLYTTYGWPQVQTVLAVRSSQILEESSRPVMLAYQNFVN |
| IPD080Adc | (51) | DAFLRSPTPWGDLYTTYGWPQVQTVLAVRSSQILEETTRPVMLAYQNFVN |
| IPD080Adf | (51) | DAFLRSPTPWGDLYSTYGWPQVQTVLAVRSSQILEETSRPVMLAYQNFVN |
| IPD080Adi | (51) | DAFLRSPTPWGDLYTTYGWPQVQTVLAVRSSQILEETSRPVMLAYQNFVN |

Fig. 1D

```
IPD080Adj  (51)  DAFLRSPTPWGDLYTTYGWPQVQTVLAVRSSQILEESSRPVMLAYQNFVN
IPD080Adk  (51)  DAFLRSPTPWGDLYTTYGWPQVQTVLAVRSSQILEESSRPVMLAYQNFVN
IPD080Bf   (51)  DAFLRSPTPWNDLYTSYGWAQVQTVLVVRSSTILEESSRPAMLAYQNFIN
IPD080Bg   (51)  DAFLRSPTPWNDLYTSYGWAQVQTVLVVRSSTILEESSRPAMLAYQNFIN
IPD080Bi   (51)  DAFLRSPTPWNDLYTSYGWAQVQTVLVVRSSTILEESSRPAMLAYQNFIN
IPD080Bh   (51)  DAFLRSPTPWNDLYTSYGWAQVQTVLVVRSSTILEESSRPAMLAYQNFIN
IPD080Bj   (51)  DAFLRSPTPWNDLYTSYGWAQVQTVLVVRSSTILEESSRPAMLAYQNFIN
IPD080Bk   (51)  DAFLRSPTPWNDLYTTYGWAQVQTVLVVRSSTILEESSRPTSLAYQNFVN
IPD080Bn   (51)  DAFLRSPTPWNDLYTTYGWAQVQTVLVVRSSTILEESSRPTSLAYQNFVN
IPD080Bm   (51)  DAFLRSPTPWNDLYTTYGWAQVQTVLVVRSSTILEESSRPTSLAYQNFVN
IPD080Bl   (51)  DAFLRSPTSWNDLYTTYGWAQVQTVLVVRSSTILEQSSRPTALAYQNFIN
IPD080Bo   (51)  DAFLRSPTPWNDLYTTYGWAQVQTVLVVRSSTILEQSSRPTALAYQNFIN
IPD080Aah  (51)  DAFLRSPTPWGDLYTTYGWPQVQTVLAVRSSQILEETSRPVMLAYQNFVN
IPD080Abp  (51)  DAFLRSPTPWGDLYTSYGWPQVQTVLAVRSSQILEETSRPVMLAYQNFVN
IPD080Abq  (51)  DAFLRSPTPWGDLYTSYGWPQVQTVLAVRSSQILEETSRPVMLAYQNFVN
IPD080Abw  (51)  DAFLRSPTPWGDLYTSYGWPQVQTVLAVRSSQILEEASRPVMLAYQNFVN
IPD080Abx  (51)  DAFLRSPTPWGDLYTSYGWPQVQTVLAVRSSQILEETSRPVMLAYQNFVN
IPD080Abi  (51)  DAFLRSPTPWGDLYTTYGWPQVQTVLAVRSSQILEETSRPVMLAYQNFVN
IPD080Ach  (51)  DAFLRSPTPWGDLYTTYGWPQVQTVLAVRSSQILEETSRPVMLAYQNFVN
IPD080Ae   (51)  DAFLRSPTPWGDLYTTYGWPQVQTVLAVRSSQILEETSRPVMLAYQNFVN
IPD080At   (51)  DAFLRSPTPWGDLYTTYGWPQVQTVLAVRSSQILEETSRPVMLAYQNFVN
IPD080Acu  (51)  DAFLRSPTPWGDLYTTYGWPQVQTVLAVRSSQILEETSRPVMLAYQNFVN
IPD080Af   (51)  DAFLRSPTPWGDLYTTYGWPQVQTVLAVRSSQILEETSRPVMLAYQNFVN
IPD080Aaa  (51)  DAFLRSPTPWGDLYTSYGWPQVQTVLAVRSSQILEETSRPVMLDYQNFVN
IPD080Ar   (51)  DAFLRSPTPWGDLYTTYGWPQVQTVLAVRSSQILEETSRPVMLDYQNFVN
IPD080Ax   (51)  DAFLRSPTPWGDLYTTYGWPQVQTVLAVRSSQILEETSRPVMLAYQNFVN
IPD080Abh  (51)  DAFLRSPTPWGDLYTTYGWPQVQTVLAVRSSQILEETSRPVMLAYQNFVN
IPD080Acv  (51)  DAFLRSPTPWGDLYTSYGWPQVQTVLAVRSSQILEETSRPVMLAYQNFVD
IPD080Acx  (51)  DAFLRSPTPWGDLYTSYGWPQVQTVLAVRSSQILEETSRPVMLAYQNFVN
IPD080Acw  (51)  DAFLRSPTPWGDLYTSYGWPQVQTVLAVRSSQILEETSRPVMLAYQNFVN
IPD080Acr  (51)  DAFLRSPTPWGDLYTTYGWPQVQTVLAVRSSQILEETSRPVMLAYQNFVN
IPD080Acs  (51)  DAFLRSPTPWGDLYTTYGWPQVQTVLAVRSSQILEETSRPVMLAYQNFVN
IPD080Act  (51)  DAFLRSPTPWGDLYTTYGWPQVQTVLAVRSSQILEETSRPVMLAYQNFVN
IPD080Aaf  (51)  DAFLRSPTPWGDLYTTYGWPQVQTVLAVRSSQILEETSRPVMLAYQNFVN
IPD080Aak  (51)  DAFLRSPTPWGDLYTTYGWPQVQTVLAVRSSQILEETSRPVMLDYRNFVN
IPD080Ay   (51)  DAFLRSPTPWGDLYTTYGWPQVQTVLAVRSSQILEETSRPVMLDYRNFVN
IPD080Abt  (51)  DAFLRSPTPWGDLYTTYGWPQVQTVLAVRSSQILEETSRPVMLAYQNFVN
IPD080Abu  (51)  DAFLRSPTPWGDLYTTYGWPQVQTVLAVRSSQILEETSRPVMLAYQNFVN
IPD080Abv  (51)  DAFLRSPTPWGDLYTTYGWPQVQTVLAVRSSQILEETSRPVMLAYQNFVN
IPD080Aad  (51)  DAFLRSPTPWGDLYTTYGWPQVQTVLAVRSSQILEETSRPVMLDYQNFVN
IPD080Au   (51)  DAFLRSPTPWGDLYTSYGWPQVQTVLAVRSSQILEETSRPVMLDYQNFVN
IPD080Acb  (51)  DAFLRSPMPG-DLYTTYGWPQVQTVLAVRSSQILEETSRPVMLDYQNFVN
IPD080Acc  (51)  DAFLRSPMPG-DLYTTYGWPQVQTVLAVRSSQILEETSRPVMLDYQNFVN
IPD080Bb   (51)  DAFLRSPTPWGDLYTTYGWPQVQTVLAVRSSQILEETSRPVMLDYQNFVN
IPD080Be   (51)  DAFLRSPMPWGDLYTTYGWPQVQTVLAVRSSQILEETSRPVMLDYQNFVN
IPD080Aav  (51)  DAFLRSPTPWGDLYTTYGWPQVQTVLAVRSSQILEETSRPVMLAYQNFVN
IPD080Aab  (51)  DAFLRSPTPWGDLYTSYGWPQVQTVLAVRSSQILEETSRPVMLAYQTFVN
IPD080Aal  (51)  DAFLRSPTPWGDLYTSYGWPQVQTVLAVRSSQILEETSRPVMLAYQTFVN
IPD080Aai  (51)  DAFLRSPTPWGDLYTTYGWPQVQTVLAVRSSQILEETSRPVMLAYQTFVN
```

Fig. 1E

```
IPD080Aaj   (51)  DAFLRSPTPWGDLYTSYGWPQVQTVLAVRSSQILEETSRPVMLAYQTFVN
IPD080Aao   (51)  DAFLRSPTPWGDLYTSYGWPQVQTVLAVRSSQILEETSRPVMLAYQTFVN
IPD080Aar   (51)  DAFLRSPTPWGDLYTSYGWPQVQTVLAVRSSQILEETSRPVMLAYQTFVN
IPD080Abc   (51)  DAFLRGPTPWGDLYTSYGWPQVQTVLAVRSSQILEETSRPVMLAYQTFVN
IPD080Abd   (51)  DAFLRSPTPWGDLYTSYGWPQVQTVLAVRSSQILEETSRPVMLAYQTFVN
IPD080Acg   (51)  DAFLRSPTPWGDLYTSYGWPQVQTVLAVRSSQILEETSRPVMLAYQTFVN
IPD080Ab    (51)  DAFLRSPTPWGDLYTSYGWPQVQTVLAVRSSQILEETSRPVMLAYQTFVN
IPD080Aby   (51)  DAFLRSPTPWGDLYTSYGWPQVQTVLAVRSSQILEETSRPVMLAYQTFVN
IPD080Abz   (51)  DAFLRSPTPWGDLYTSYGWPQVQTVLAVRSSQILEETSRPVMLAYQTFVN
IPD080Aaq   (51)  DAFLRSPTPWGDLYTSYGWPQVQTVLAVRSSQILEETSRPVMLAYQTFVN
IPD080Aas   (51)  DAFLRSPTPWGDLYTSYGWPQVQTVLAVRSSQILEETSRPVMLAYQTFVN
IPD080Ad    (51)  DAFLRSPTPWGDLYTSYGWPQVQTVLAVRSSQILEETSRPVMLAYQTFVN
IPD080Ba    (51)  DAFLRSPTPWGDLYTSYGWPQVQTVLAVRSSQILEETSRPVMLAYQTFVN
IPD080Bc    (51)  DAFLRSPTPWGDLYTSYGWPQVQTVLAVRSSQILEETSRPVMLAYQTFVN
IPD080Bd    (51)  DAFLRSPTPWGDLYTSYGWPQVQTVLAVRSSQILEETSRPVMLAYQTFVN
IPD080Aci   (51)  DAFLRSPTPWGDLYTSYGWPQVQTVLAVRSSQILEETSRPVMLAYQTFVN
IPD080Acj   (51)  DAFLRSPTPWGDLYTSYGWPQVQTVLAVRSSQILEETSRPVMLAYQTFVN
IPD080Aap   (51)  DAFLRSPTPWGDLYTSYGWPQVQTVLAVRSSQILEETSRPVMLAYQNFVN
IPD080Abm   (51)  DAFLRSPTPWGDLYTSYGWPQVQTVLAVRSSQILEETSRPVMLAYQNFVN
IPD080Abn   (51)  DAFLRSPTPWGDLYTSYGWPQVQTVLAVRSSQILEETSRPVMLAYQNFVN
IPD080Abo   (51)  DAFLRSPTPWGDLYTSYGWPQVQTVLAVRSSQILEETSRPVMLAYQNFVN
IPD080Ao    (51)  DAFLRSPTPWGDLYTSYGWPQVQTVLAVRSSQILEETSRPVMLAYQNFVN
IPD080Aac   (51)  DAFLRSPTPWGDLYTSYGWPQVQTVLAVRSSQILEETSRPVMLAYQNFVN
IPD080Aae   (51)  DAFLRSPTPWGDLYTSYGWPQVQTVLAVRSSQILEETSRPVMLAYQNFVN
IPD080Aw    (51)  DAFLRSPTPWGDLYTSYGWPQVQTVLAVRSSQILEETSRPVMLAYQNFVN
IPD080Az    (51)  DAFLRSPTPWGDLYTSYGWPQVQTVLAVRSSQILEETSRPVMLAYQNFVN
IPD080Acd   (51)  DAFLRSPTPWGDLYTSYGWPQVQTVLAVRSSQILEETSRPVMLAYQNFVN
IPD080Ace   (51)  DAFLRSPTPWGDLYTSYGWPQVQTVLAVRSSQILEETSRPVMLAYQNFVN
IPD080Aam   (51)  DAFLRSPTPWGDLYTSYGWPQVQTVLAVRSSQILEETSRPVMLAYQNFVN
IPD080Aan   (51)  DAFLRSPTPWGDLYTSYGWPQVQTVLAVRSSQILEETSRPVMLAYQNFVN
IPD080Acq   (51)  DAFLRSPTPWGDLYTSYGWPQVQTVLAVRSSQILEETSRPVMLAYQNFVN
IPD080Aba   (51)  DAFLRSPTPWGDLYTTYGWPQVQTVLAVRSSQILEETSRPVMLAYQNFVN
IPD080Acn   (51)  DAFLRSPTPWGDLYTTYGWPQVQTVLAVRSSQILEETSRPVMLAYQNFVN
IPD080Aco   (51)  DAFLRSPTPWGDLYTTYGWPQVQTVLAVRSSQILEETSRPVMLAYQNFVN
IPD080Acp   (51)  DAFLRSPTPWGDLYTTYGWPQVQTVLAVRSSQILEETSRPVMLAYQNFVN
IPD080Aca   (51)  DAFLRSPTPWGDLYTTYGWPQVQTVLAVRSSQILEETSRPVMLDYRNFVN
IPD080Ah    (51)  DAFLRSPTPWGDLYTTYGWPQVQTVLAVRSSQILEETSRPVMLAYQNFVN
IPD080Aag   (51)  DAFLRSPTPWGDLYTSYGWPQVQTVLAVRSSQILEETSRPVMLAYQNFVN
IPD080Ac    (51)  DAFLRSPTPWGDLYTSYGWPQVQTVLAVRSSQILEETSRPVMLAYQNFVN
IPD080Av    (51)  DAFLRSPTPWGDLYTSYGWPQVQTVLAVRSSQILEETSRPVMLAYQNFVN
IPD080Abk   (51)  DAFLRSPTPWGDLYTTYGWPQVQTVLAVRSSQILEETSRPVMLAYQNFVN
IPD080Abl   (51)  GAFLRSPTPWGDLYTTYGWPQVQTVLAVRSSQILEETSRPVMLAYQNFVN
IPD080Aq    (51)  DAFLRSPTPWGDLYTTYGWPQVQTVLAVRSSQILEETSRPVMLAYQNFVN
IPD080Abr   (51)  DAFLRSPTPWGDLYTTYGWPQVQTVLAVRSSQILEETSRPVMLAYQNFVN
IPD080Abs   (51)  DAFLRSPTPWGDLYTTYGWPQVQTVLAVRSSQILEETSRPVMLAYQNFVN
IPD080Am    (51)  DAFLRSPTPWGDLYTTYGWPQVQTVLAVRSSQILEETSRPVMLAYQNFVN
IPD080Aax   (51)  DAFLRSPTPWGDLYTTYGWPQVQTVLAVRSSQILEETSRPVMLAYQNFVN
IPD080Aay   (51)  DAFLRSPTPWGDLYTTYGWPQVQTVLAVRSSQILEETSRPVMLAYQNFVN
IPD080As    (51)  DAFLRSPTPWGDLYTTYGWPQVQTVLAVRSSQILEETSRPVMLAYQNFVN
```

Fig. 1F

| | | |
|---|---|---|
| IPD080Ag | (51) | DAFLRSPTPWGDLYTTYGWPQVQTVLAVRSSQILEETSRPVMLAYQNFVN |
| IPD080Abe | (51) | DAFLRSPTPWGDLYTTYGWPQVQTVLAVRSSQILEETSRPVMLAYQTFVN |
| IPD080Abf | (51) | DAFLRSPTPWGDLYTTYGWPQVQTVLAVRSSQILEETSRPVMLAYQTFVN |
| IPD080Abg | (51) | DAFLRSPTPWGDLYTTYGWPQVQTVLAVRSSQILEETSRPVMLAYQTFVN |
| IPD080Acl | (51) | DAFLRSPTPWGDLYTSYGWPQVQTVLAVRSSQILEETSRPVMLAYQTFVN |
| IPD080Acm | (51) | DAFLRSPTPWGDLYTSYGWPQVQTVLAVRSSQILEETSRPVMLAYQTFVN |
| IPD080Ak | (51) | DAFLRSPTPWGDLYTTYGWPQVQTVLAVRSSQILEETSRPVMLAYQNFVN |
| IPD080Al | (51) | DAFLRSPTPWGDLYTTYGWPQVQTVLAVRSSQILEETSRPVMLAYQNFVN |
| IPD080Ap | (51) | DAFLRSPTPWGDLYTTYGWPQVQTVLAVRSSQILEETSRPVMLAYQNFVN |
| IPD080Aat | (51) | DAFLRSPTPWGDLYTTYGWPQVQTVLAVRSSQILEETSRPVMLAYQNFVN |
| IPD080Aau | (51) | DAFLRSPTPWGDLYTTYGWPQVQTVLAVRSSQILEETSRPVMLAYQNFVN |
| IPD080Aaw | (51) | DAFLRSPTPWGDLYTTYGWPQVQTVLAVRSSQILEETSRPVMLAYQNFVN |
| IPD080Aaz | (51) | DAFLRSPTPWGDLYTTYGWPQVQTVLAVRSSQILEETSRPVMLAYQNFVN |
| IPD080Ack | (51) | DAFLRSPTPWGDLYTTYGWPQVQTVLAVRSSQILEETSRPVMLAYQNFVN |
| IPD080Aj | (51) | DAFLRSPTPWGDLYTTYGWPQVQTVLAVRSSQILEETSRPVMLAYQNFVN |

```
                     101                                              150
```

| | | |
|---|---|---|
| IPD080Aa | (101) | NTNTEATYTASMSRAVTNSSSNTWSNTHSLTFEQKIKYGINFGITAEGET |
| IPD080Abj | (101) | NTNTEAEYTANMSREMTNSSSNTWSNTHSLTFEQKIKYGINFGITAEGET |
| IPD080Ai | (101) | NTNTEAEYTANMSREMTNSSSNTWSNTHSLTFEQKIKYGINFGITAEGET |
| IPD080Acf | (101) | NTNTEATYTANMSRSVTNSSSNTWSNTHSLAFEQKIKYGINFGITAEGET |
| IPD080An | (101) | NTNTEATYTANMSREVTNSSSNTWSNTHSLTFEQKIKYGINFGITAEGET |
| IPD080Acy | (101) | NTNTEATYTANMSREMTNSSSNTWSNTHSLSFEQKIKYGINFGITAVGET |
| IPD080Adb | (101) | NTNTEATYTANMSREMTNSSSNTWSNTHSLSFEQKIKYGINFGITAVGET |
| IPD080Adg | (101) | NTNTEATYTANMSREMTNSSSNTWSNTHSLSFEQKIKYGINFGITAVGET |
| IPD080Ada | (101) | NTNTEATYTANMSREMTNSSSNTWSNTHSLSFEQKIKYGINFGITAVGET |
| IPD080Adh | (101) | NTNTEATYTANMSRVVTNSSSNTWSNTHSFTFEQKIKYGINFGITAVGET |
| IPD080Acz | (101) | NTNTEATYTANMSREMTNSSSNTWSNTHSLSFEQKIKYGINFGITAVGET |
| IPD080Ade | (101) | NTNTEATYTANMSREMTNSSSNTWSNTHSLSFEQKIKYGINFGITAVGET |
| IPD080Adc | (101) | NTNTEATYTANMSREMTNSSSNTWSNTHSLSFEQKIKYGINFGITAVGET |
| IPD080Adf | (101) | NTNTEATYTASMSRAVTNSSSNTWSNTHSLTFEQKIKYGINFGITAEGET |
| IPD080Adi | (101) | NTNTEATYTASMSRAVTNSSSNTWSNTHSLTFEQKIKYGINFGITAEGET |
| IPD080Adj | (101) | NTNTEATYTASMSRAVTNSSSNTWSNTHSLTFEQKIKYGINFGITAEGET |
| IPD080Adk | (101) | NTNTEATYTASMSRAVTNSSSNTWSNTHSLTFEQKIKYGINFGITAEGET |
| IPD080Bf | (101) | NTSTEATYTAEMSRAMTNSSSNTWSNTHNIRFEQTITYKINFGITAGGET |
| IPD080Bg | (101) | NTSTEATYTAEMSRAMTNSSSNTWSNTHNIRFEQTITYKINFGITAGGET |
| IPD080Bi | (101) | NTSTEATYTAEMSRAMTNSSSNTWSNTHNIRFEQTITYKINFGITAGGET |
| IPD080Bh | (101) | NTSTEATYTAEMSRAMTNSSSNTWSNTHNIRFEQTITYKINFGITAGGET |
| IPD080Bj | (101) | NTSTEATYTAEMSRAMTNSSSNTWSNTHNIRFEQTITYKINFGITAGGET |
| IPD080Bk | (101) | NTSSEATYTAHLSREMTNSSSNTWSNTHSIRFEQTITYKINFGITAGGET |
| IPD080Bn | (101) | NTSSEATYTAHLSREMTNSSSNTWSNTHSIRFEQTITYKINFGITAGGET |
| IPD080Bm | (101) | NTSSEATYTAHLSREMTNSSSNTWSNTHSIRFEQTITYKINFGITAGGET |
| IPD080Bl | (101) | NTSTEATYTAQLSREMTNSSSNTWSNTHSIRFEQTITYKINFGITAGGET |
| IPD080Bo | (101) | NTSTEATYTAQLSREMTNSSSNTWSNTHSIRFEQTITYKINFGITAGGET |
| IPD080Aah | (101) | NTNTEAEYTANMSREMTNSSSNTWSNTHSLTFEQKIKYGINFGITAEGET |
| IPD080Abp | (101) | NTNTEAEYTANMSREMTNSSSNTWSNTHSLTFEQKIKYGINFGITAEGET |
| IPD080Abq | (101) | NTNTEAEYTANMSREMTNSSSNTWSNTHSLTFEQKIKYGINFGITAEGET |
| IPD080Abw | (101) | NTNTEAEYAANMSRGMTNSSSNTWSNTHSLTFEQKIKYGINFGITAEGET |

Fig. 1G

```
IPD080Abx  (101)  NTNTEAEYTANMSREMTNSSSNTWSNTHSLTFEQKIKYGINFGITAEGET
IPD080Abi  (101)  NTNTEATYTANMSREVTNSSSNTWSNTHSLTFEQKIKYGINFGITAEGET
IPD080Ach  (101)  NTNTEATYTANMSREVTNSSSNTWSNTHSLTFEQKIKYGINFGITAEGET
IPD080Ae   (101)  NTNTEATYTANMSREVTNSSSNTWSNTHSLTFEQKIKYGINFGITAEGET
IPD080At   (101)  NTNTEATYTANMSREVTNSSSNTWSNTHSLTFEQKIKYGINFGITAEGET
IPD080Acu  (101)  NTNTEATYTANMSREVTNSSSNTWSNTHSLTFEQKIKYGINFGITAEGET
IPD080Af   (101)  NTNTEATYTANMSRAMTNSSSNTWSNTHSLTFEQKIKYGINFGITAEGET
IPD080Aaa  (101)  NTNTEATYTANMSRAVTNSSSNTWSNTHSLAFEQKIKYGINFGITAQGET
IPD080Ar   (101)  NTNTEATYTANMSRAVTNSSSNTWSNTHSLAFEQKIKYGINFGITAQGET
IPD080Ax   (101)  NTNTEATYTANMSRAVTNSSSNTWSNTHSLAFEQKIKYGINFGITAQGET
IPD080Abh  (101)  NTNTEATYTANMSRAVTNSSSNTWSNTHSLAFEQKIKYGINFGITAQGET
IPD080Acv  (101)  NTNTEATYTANMSRAVTNSSSNTWSNTHSLAFEQIKYGINFGITAQGET
IPD080Acx  (101)  NTNTEATYTANMSRAVTNSSSNTWSNTHSLAFEQKIKYGINFGITAQGET
IPD080Acw  (101)  NTNTEATYTANMSRAVTNSSSNTWSNTHSLAFEQKIKYGISFGITAQGET
IPD080Acr  (101)  NSNTEATYTANMSRAVTNSSSNTWSNTHSLAFEQKIKYGINFGITAEGET
IPD080Acs  (101)  NSNTEATYTANMSRAVTNSSSNTWSNTHSLAFEQKIKYGINFGITAEGET
IPD080Act  (101)  NSNTEATYTANMSRAVTNSSSNTWSNTHSLAFEQKIKYGINFGITAEGET
IPD080Aaf  (101)  NTNTEATYTANMSREVTNSSSNTWSNTHSLAFQQKIKYGINFGITAEGET
IPD080Aak  (101)  NTNTEATYTANMSPSVTNSSSNTWSNTHSLAFEQKIKYGINFGITAQGET
IPD080Ay   (101)  NTNTEATYTANMSRSVTNSSSNTWSNTHSLAFEQKIKYGINFGITAQGET
IPD080Abt  (101)  NTNTEATYTANMSRAVTNSSSNAWSNSHSLSFQQKIKYGINFGITAQGET
IPD080Abu  (101)  NTNTEATYTANMSRAVTNSSSNAWSNSHSLSFQQKIKYGINFGITAQGET
IPD080Abv  (101)  NTNTEATYTANMSRAVTNSSSNAWSNSHSLSFQQKIKYGINFGITAQGET
IPD080Aad  (101)  NTNTEATYPANMSRAVTTSLSNTWSNTHSLAFEQKIKYGINFGITAEGET
IPD080Au   (101)  NTNTEATYPANMSRAVTTSLSNTWSNTHSLAFEQKIKYGINFGITAEGET
IPD080Acb  (100)  NTNTEATYPANMSRAVTTSLPNTWSNTHSLAFEQKIKYGINFGITAQGGT
IPD080Acc  (100)  NTNTEATYPANMSRAVTTSLSNTWSNTHSLAFEQKIKYGINFGITAQGGT
IPD080Bb   (101)  NTNTEATYPANMSRAVTTSLSNTWSNTHSLAFEQKIKYGINFGITAQGGT
IPD080Be   (101)  NTNTEATYPANMSRAVTTSLSNTWSNTHSLAFEQKIKYGISFGITAQGGT
IPD080Aav  (101)  NTNTEATYTANMSRAMTNSSSNTWSNTHSLSFQQKIKYGINFGITAEGET
IPD080Aab  (101)  NTNTEATYTANMSRVMRNSSSNAWSNTHSLSFQQKIKYGINFGITAQGET
IPD080Aal  (101)  NTNTEATYTANMSRVMRNSSSNAWSNTHSLSFQQKIKYGINFGITAQGET
IPD080Aai  (101)  NTNTEATYTANMSRVMRNSSSNAWSNTHSLSFQQKIKYGINFGITAQGET
IPD080Aaj  (101)  NTNTEATYTANMSRVMRNSSSNAWSNTHSLSFQQKIKYGINFGITAQGET
IPD080Aao  (101)  NTNTEATYTANMSRVMRNSSSNAWSNTHSLSFQQKIKYGINFGITAQGET
IPD080Aar  (101)  NTNTEATYTANMSRVMRNSSSNAWSNTHSLSFQQKIKYGINFGITAQGET
IPD080Abc  (101)  NTNTEATYTANMSRVMRNSSSNAWSNTHSLSFQQKIKYGINFGITAQGET
IPD080Abd  (101)  NTNTEATYTANMSRVMRNSSSNAWSNTHSLSFQQKIKYGINFGITAQGET
IPD080Acg  (101)  NTNTEATYTANMSRVMRNSSSNAWSNTHSLSFQQKIKYGINFGITAQGET
IPD080Ab   (101)  NTNTEATYTANMSRVMRNSSSNAWSNTHSLSFQQKIKYGINFGITAQGET
IPD080Aby  (101)  NTNTEATYTANMSRVMRNSSSNAWSNTHSLSFRQKIKYGINFGITAQGET
IPD080Abz  (101)  NTNTEATYTANMSRVMRNSSSNAWSNTHSLSFQQKIKYGINFGITAQGET
IPD080Aaq  (101)  NTNTEATYTANMSRVMRNSSSNAWSNTHSLSFQQKIKYGINFGITAQGET
IPD080Aas  (101)  NTNTEATYTANMSRVMRNSSSNAWSNTHSLSFQQKIKYGINFGITAQGET
IPD080Ad   (101)  NTNTEATYTANMSRVMRNSSSNAWSNTHSLSFQQKIKYGINFGITAQGET
IPD080Ba   (101)  NTNTEATYTANMSRVMRNSSSNAWSNTHSLSFQQKIKYGINFGITAQGET
IPD080Bc   (101)  NTNTEATYTANMSRVMRNSSSNAWSNTHSLSFQQKIKYGINFGITAQGET
IPD080Bd   (101)  NTNTEATYTANMSRVMRNSSSNAWSNTHSLSFQQKIKYGINFGITAQGET
IPD080Aci  (101)  NTNTEATYTANMSRVMRNSSSNAWSNTHSLSFQQKIKYGINFGITAEGET
```

Fig. 1H

```
IPD080Acj  (101) NTNTEAAYTANMSRVMRNSSSNAWSNTHSLSFQQKIKYGINFGITAEGET
IPD080Aap  (101) NTNTEATYTANMSRVMRNSSSNAWSNTHSLSFQQKIKYGINFGITAQGET
IPD080Abm  (101) NTNTEATYTANMSRAMTYSSSNTWSNTHSLSFQQKIKYGINFGITAQGET
IPD080Abn  (101) NTNTEATYTANMPRAMTNSSSNTWSNTHSLSFQQKIKYGINFGITAQGET
IPD080Abo  (101) NTNTEATYTANMSRAMTNSSSNTWSNTHSLSFQQKIKYGINFGITAQGET
IPD080Ao   (101) NTNTEATYTANMSRAMTNSSSNTWSNTHSLSFQQKIKYGINFGITAQGET
IPD080Aac  (101) NTNTEATYTANMSRAMTNSSSNTWSNTHSLSFQQKITYGINFGITAEGET
IPD080Aae  (101) NTNTEATYTANMSRAMTNSSSNTWSNTHSLSFQQKITYGINFGITAEGET
IPD080Aw   (101) NTNTEATYTANMSRAMTNSSSNTWSNTHSLSFQQKITYGINFGITAEGET
IPD080Az   (101) NTNTEATYTANMSRAMTNSSSNTWSNTHSLSFQQKITYGINFGITAEGET
IPD080Acd  (101) NTNTEATYTADMSRAMTNSSSNTWSNTHSLSFQQKITYGINFGITAEGET
IPD080Ace  (101) NTNTEATYTADMSRAMTNSSSNTWSNTHSLSFQQKITYGINFGITAEGET
IPD080Aam  (101) NTNTEATYTADMSRAMTNSSSNTWSNTHSLSFQQKITYGINFGITAEGET
IPD080Aan  (101) NTNTEATYTADMSRAMTNSSSNTWSNTHSLSFQQKITYGINFGITAEGET
IPD080Acq  (101) NTNTEATYTANMSRAMTNSSSNTWSNTHSLSFQQKIKYGINFGITAEGET
IPD080Aba  (101) NTNTEATYTADMSRAMTNSSSNTWSNTHSLSFQQKITYGINFGITAEGET
IPD080Acn  (101) NTNTEATYTADMSRAMTNSSSNTWSNTHSLSFQQKITYGINFGITAEGET
IPD080Aco  (101) NTNTEATYTADMSRAMTNSSSNTWSNTHSLSFQQKITYGINFGITAEGET
IPD080Acp  (101) NTNTEATYTADMSRAMTNSSSNTWSNTHSLSFQQKITYGINFGITAEGET
IPD080Aca  (101) NTNTEATYTANMSRAMTNSSSNTWSNTHSLSFQQKITYGINFGITAQGET
IPD080Ah   (101) NTNTEATYTANMSRAMTNSSSNTWSNTHSLSFQQKIKYGINFGITAEGET
IPD080Aag  (101) NTNTEATYTANMSRAMTNSSSNTWSNTHSLSFQQKITYGINFGITAEGET
IPD080Ac   (101) NTNTEATYTADMSRAMTNSSSNTWSNTHSLSFQQKITYGINFGITAEGET
IPD080Av   (101) NTNTEATYTANMSRAMTNSSSNTWSNTHSLSFQQKIKYGINFGITAQGET
IPD080Abk  (101) NTNTEATYTANMSRSVTNSSSNTWSNTHSLAFEQKIKYGINFGITAQGET
IPD080Abl  (101) NTNTEATYTANMSRSVTNSSSNTWSNTHSLAFEQKIKYGINFGITAQGET
IPD080Aq   (101) NTNTEATYTANMSREVTNSSSNTWSNTHSLTFEQKIKYGINFGITAEGET
IPD080Abr  (101) NTNTEATYTANMSREVTNSSSNTWSNTHSLSFQQKIKYGINFGITAQGET
IPD080Abs  (101) NTNTEATYTANMSREVTNSSSNTWSNTHSLSFQQKIKYGINFGITAQGET
IPD080Am   (101) NTNTEATYTANMSRAMTNSSSNTWSNTHSLSFQQKIKYGINFGITAQGET
IPD080Aax  (101) NTNTEATYTANMSRAMTNSSSNTWSNTHSLSFQQKIKYGINFGITAEGET
IPD080Aay  (101) NTNTEATYTANMSRAMTNSSSNTWSNTHSLSFQQKIKYGINFGITAEGET
IPD080As   (101) NTNTEATYTANMSRAMTNSSSNTWSNTHSLSFQQKIKYGINFGITAEGET
IPD080Ag   (101) NTNTEATYTANMSRAMTNSSSNTWSNTHSLSFQQKIKYGINFGITAEGET
IPD080Abe  (101) NTNTEATYTANMSRVMRNSSSNAWSNTHSLSFQQKIKYGINFGITAEGET
IPD080Abf  (101) DTNTEATYTANMSRVMRNSSSNAWSNTHSLSFQQKIKYGINFGITAEGET
IPD080Abg  (101) NTNTEATYTANMSRVMRNSSSNAWSNTHSLSFQQKIKYGINFGITAEGET
IPD080Acl  (101) NTNTEATYTANMSRAMTNSSSNTWSNTHSLSFQQKIKYGINFGITAEGET
IPD080Acm  (101) NTNTEATYTANMSRAMTNSSSNTWSNTHSLSFQQKIKYGINFGITAEGET
IPD080Ak   (101) NTNTEATYTANMSRAMTNSSSNTWSNTHSLSFQQKIKYGINFGITAEGET
IPD080Al   (101) NTNTEATYTANMSRAMTNSSSNTWSNTHSLSFQQKIKYGINFGITAEGET
IPD080Ap   (101) NTNTEATYTANMSRAMTNSSSNTWSNTHSLSFQQKIKYGINFGITAEGET
IPD080Aat  (101) NTNTEATYTANMSRAMTNSSSNTWSNTHSLSFQQKIKYGINFGITAEGET
IPD080Aau  (101) NTNTEATYTANMSRAMTNSSSNTWSNTHSLSFQQKIKYGINFGITAEGET
IPD080Aaw  (101) NTNTEATYTANMSRAMTNSSSNTWSNTHSLSFQQKIKYGINFGITAEGET
IPD080Aaz  (101) NTNTEATYTANISRAMTNSSSNTWSNTHSLSFQQKIKYGINFGITAEGET
IPD080Ack  (101) NTNTEATYTANMSRAMTNSSSNTWSNTHSLSFQQKIKYGINFGITAEGET
IPD080Aj   (101) NTNTEATYTANMSRAMTNSSSNTWSNTHSLSFQQNIKYGINFGITAEGET
```

Fig. 1I

```
                     151                                                200
IPD080Aa    (151)    TLSYEFSFGQSGTESVSTTLSTGAGVSVVVAPHRTKHAILSASEGRMRVR
IPD080Abj   (151)    TLSYEFSFGQSGTESVSTTLSTGAGVSVMVGPHRTKHVILSASEGRMRVR
IPD080Ai    (151)    TLSYEFSFGQSGTESVSTTLSTGAGVSVMVGPHRTKHVILSASEGRMRVR
IPD080Acf   (151)    TLSYEFSFGQSGTESVSTTLSTGAGVSVMVGPHRTKHVILSASEGRMRVR
IPD080An    (151)    TLSYEFSFGQSGTESVSTTLSTGAGVSVMVGPHRTKHVILSASEGRMRVR
IPD080Acy   (151)    TLSYEFSFGQSGTESVSTTLSTGAGVSVVVGPQRTKHAILSASEGRMRVR
IPD080Adb   (151)    TLSYEFSFGQSGTESVSTTLSTGAGVSVVVGPQRTKHAILSASEGRMRVR
IPD080Adg   (151)    TLSYEFSFGQSGTESVSTTLSTGAGVSVVVGPQRTKHAILSASEGRMRVR
IPD080Ada   (151)    TLSYEFSFGQSGTESVSTTLSSGAGVSVVVGPHQTKHAILSASEGRMRVR
IPD080Adh   (151)    TLSYEFSFGQSGTESVSTTLSTGAGVSVVVGPQRTKHAILSASEGRMRVR
IPD080Acz   (151)    TLSYEFSFGQSGTESVSTTLSTGAGVSVVVGPQRTKHAILSASEGRMRVR
IPD080Ade   (151)    TLSYEFSFGQSGTESVSTTLSTGAGVSVVVGPQRTKHAILSASEGRMRVR
IPD080Adc   (151)    TLSYEFSFGQSGTESVSTTLSTGAGVSVVVGPQRTKHAILSASEGRMRVR
IPD080Adf   (151)    TLSYEFSFGQSGTESVSTTLSTGAGVSVVVAPHRTKHAILSASEGRMRVR
IPD080Adi   (151)    TLSYEFSFGQSGTESVSTTLSTGAGVSVVVGPQRTKHAILSASEGRMRVR
IPD080Adj   (151)    TLSYEFSFGQSGTESVSTTLSTGAGVSVVVAPHRTKHAILSASEGRMRVR
IPD080Adk   (151)    TLSYEFSFGQSGTESVSTTLSTGAGVSVVVAPHRTKHAILSASEGRMRVR
IPD080Bf    (151)    SMGYEFSFGQSGTTETSTTISSGAAVSVVVGPHRTKHAILSASEGRMRVR
IPD080Bg    (151)    SMGYEFSFGQSGTTETSTTISSGAAVSVVVGPHRTKHAILSASEGRMRVR
IPD080Bi    (151)    SMGYEFSFGQSGTTETSTTISSGAAVSVVVGPHRTKHAILSASEGRMRVR
IPD080Bh    (151)    SMGYEFSFGQSGTNETSTTISSGAAVSVVVGPHRTKHAILSASEGRMRVR
IPD080Bj    (151)    SMGYEFSFGQSGTNETSTTISSGAAVSVVVGPHRTKHAILSASEGRMRVR
IPD080Bk    (151)    SFGYESSFGQSGTHETSTTISSGASVSVVVGPHRTKHAILSASEGRMRVR
IPD080Bn    (151)    SFGYESSFGQSGTHETSTTISSGASVSVVVGPHRTKHAILSASEGRMRVR
IPD080Bm    (151)    SFGYESSFGQSGTHETSTTISSGASVSVVVGPHRTKHAILSASEGRMRVR
IPD080Bl    (151)    SLGYESSFGQSGTHETSTTISSGASVSVVVGPHRTKHAILSASEGRMRVR
IPD080Bo    (151)    SLGYESSFGQSGTHETSTTISSGASVSVVVGPHRTKHAILSASEGRMRVR
IPD080Aah   (151)    TLSYEFSFGQSGTESVSTTLSTGAGVSVMVGPHRTKHVILSASEGRMRVR
IPD080Abp   (151)    TLSYEFSFGQSGTESVSTTLSTGAGVSVMVGPHRTKHVILSASEGRMRVR
IPD080Abq   (151)    TLSYEFSFGQSGTESVSTTLSTGAGVSVMVGPHRTKHVILSASEGRMRVR
IPD080Abw   (151)    TLSYEFSFGQSGTESVSTTLSTGAGVSVMVGPHRTKHVILSASEGRMRVR
IPD080Abx   (151)    TLSYEFSFGQSGTESVSTTLSTGAGVSVMVGPHRTKHVILSASEGRMRVR
IPD080Abi   (151)    TLSYEFSFGQSGTESVSTTISTGAGVSVVVGPHRTKHAILSASEGRMRVR
IPD080Ach   (151)    TLSYEFSFGQSGTESVSTTISTGAGVSVVVGPHRTKHAILSASEGRMRVR
IPD080Ae    (151)    TLSYEFSFGQSGTESVSTTISTGAGVSVVVGPHRTKHAILSASEGRMRVR
IPD080At    (151)    TLSYEFSFGQSGTESVSTTISTGAGVSVVVGPHRTKHAILSASEGRMRVR
IPD080Acu   (151)    TLSYEFSFGQSGTESVSTTISTGAGVSVVVGPHRTKHAILSASEGRMRVR
IPD080Af    (151)    TLSYEFSFGQSGTESVSTTISTGAGVSVVVGPHRTKHAILSASEGRMRVR
IPD080Aaa   (151)    TLSYEFSFGQSGTKSVSTTISTGAGVSVVVGPHRTKHAILSASEGRMRVR
IPD080Ar    (151)    TLSYEFSFGQSGTKSVSTTISTGAGVSVVVGPHRTKHAILSASEGRMRVR
IPD080Ax    (151)    TLSYEFSFGQSGTESVSTTISTGAGVSVVVGPHRTKHAILSASEGRMRVR
IPD080Abh   (151)    TLSYEFSFGQSGTESVSTKISTGAGVSVVVGPHRTKHAILSASEGRMRVR
IPD080Acv   (151)    TLSYEFSFGQSGTESVSTKISTGAGVSVVVGPHRTKHAILSASEGRMRVR
IPD080Acx   (151)    TLSYEFSFGQSGTESVSTKISTGAGVSVVVGPHRTKHAILSASEGRMRVR
IPD080Acw   (151)    TLSYEFSFGQSGTESVSTKISTGAGVSVVVGPHRTKHAILSASEGRMRVR
IPD080Acr   (151)    TLSYEFSFGQSGTESVSTTISTGAGVSVVVGPHRTKHAILSASEGRMRVR
IPD080Acs   (151)    TLSYEFSFGQSGTESVSTTISTGAGVSVVVGPHRTKHAILSASEGRMRVR
IPD080Act   (151)    TLSYEFSFGQSGTESVSTTISTGAGVSVVVGPHRTKHAILSASEGRMRVR
```

Fig. 1J

```
IPD080Aaf  (151) TLSYQFSFGQSGTESVSTTISTGAGVSVVVGPHRTKHAILSASEGRMRVR
IPD080Aak  (151) TLSYEFSFGQSGTESVSTTISTGAGVSVVVGPHRTKHAILSASEGRMRVR
IPD080Ay   (151) TLSYEFSFGQSGTESVSTTISTGAGVSVVVGPHRTKHAILSASEGRMRVR
IPD080Abt  (151) TLSYKFSFGQSGTESVSTTISTGAGVSVVVGPHRTKHAILSASEGRMRVR
IPD080Abu  (151) TLSYKFSFGQSGTESVSTTISTGAGVSVVVGPHRTKHAILSASEGRMRVR
IPD080Abv  (151) TLSYKFSFGQSGTESVSTTISTGAGVSVVVGPHRTKHAILSASEGRMRVR
IPD080Aad  (151) TLSYQFSFGQSGTESVSTTISTGAGVSVVVGPHRTKHAILSASEGRMRVR
IPD080Au   (151) TLSYQFSFGQSGTESVSTTISTGAGVSVVVGPHRTKHAILSASEGRMRVR
IPD080Acb  (150) TLSYKFSFGQSWTESVSITIS--AVESVVVGPHQTKHAILSALEGRMRVR
IPD080Acc  (150) TLSYKFSFGQSWTESVSITIS--AVESVVVGPHQTKHAILSALEGRMRVR
IPD080Bb   (151) TLSYKFSFGQSWTESVSITIS--AVASVVVGPHQTKHAILSALEGRMRVR
IPD080Be   (151) TLSYKFSFGQSWTESVSITIS--AVASVVVGPHQTKHAILSALEGQMRVR
IPD080Aav  (151) TLSYQFSFGQSGTESVSTTISTGAGVSVVVGPHRTKHAILSASEGRMRVR
IPD080Aab  (151) TLSYKFSFGQSGTESVSTTISTGAGVSVVVAPHRTKHAILSASEGRMRVR
IPD080Aal  (151) TLSYQFSFGQSGTESVSTTISTGAGVSVVVAPHRTKHAILSASEGRMRVR
IPD080Aai  (151) TLSYQFSFGQSGTESVSTTISTGAGVSVVVAPHRTKHAILSASEGRMRVR
IPD080Aaj  (151) TLSYQFSFGQSGTESVSTTISTGAGVSVVVAPHRTKHAILSASEGRMRVR
IPD080Aao  (151) TLSYQFSFGQSGTESVSTTISTGAGVSVVVAPHRTKHAILSASEGRMRVR
IPD080Aar  (151) TLSYQFSFGQSGTESVSTTISTGAGVSVVVAPHRTKHAILSASEGRMRVR
IPD080Abc  (151) TLSYKFSFGQSGTESVSTTISTGAGVSVVVAPHRTKHAILSASEGRMRVR
IPD080Abd  (151) TLSYKFSFGQSGTESVSTTISTGAGVSVVVAPHRTKHAILSASEGRMRVR
IPD080Acg  (151) TLSYQFSFGQSGTESVSTTISTGAGVSVVVAPHRTKHAILSASEGRMRVR
IPD080Ab   (151) TLSYKFSFGQSGTESVSTTISTGAGVSVVVAPHRTKHAILSASEGRMRVR
IPD080Aby  (151) TLSYKFSFGQSGTESVSTTISTGAGVSVVVAPHRTKHAILSASEGRMRVR
IPD080Abz  (151) TLSYKFSFGQSGTESVSTTISTGAGVSVVVAPHRTKHAILSASEGRMRVR
IPD080Aaq  (151) TLSYQFSFGQSGTESVSTTISTGAGVSVVVGPHRTKHAILSASEGRMRVR
IPD080Aas  (151) TLSYQFSFGQSGTESVSTTISTGAGVSVVVGPHRTKHAILSASEGRMRVR
IPD080Ad   (151) TLSYQFSFGQSGTESVSTTISTGAGVSVVVAPHRTKHAILSASEGRMRVR
IPD080Ba   (151) TLSYQFSFGQSGTESVSTTISTGAGVSVVVAPHRTKHAILSASEGRMRVR
IPD080Bc   (151) TLSYQFSFGQSGTESVSTTISTGAGVSVVVAPHRTKHAILSASEGRMRVR
IPD080Bd   (151) TLSYQFSFGQSGTESVSTTISTGAGVSVVVAPHRTKHAILSASEGRMRVR
IPD080Aci  (151) TLSYQFSFGQSGTESVSTTISTGAGVSVVVAPHRTKHAILSASEGRMRVR
IPD080Acj  (151) TLSYQFSFGQSGTESVSTTISTGAGVSVVVAPHRTKHAILSASEGRMRVR
IPD080Aap  (151) TLSYQFSFGQSGTESVSTTISTGAGVSVVVAPHRTKHAILSASEGRMRVR
IPD080Abm  (151) TLSYQFSFGQSGTESVSTTISTGAGVSVVVAPHRTKHAILSASEGRMRVR
IPD080Abn  (151) TLSYQFSFGQSGTESVSTTISTGAGVSVVVAPHRTKHAILSASEGRMRVR
IPD080Abo  (151) TLSYQFSFGQSGTESVSTTISTGAGVSVVVAPHRTKHAILSASEGRMRVR
IPD080Ao   (151) TLSYQFSFGQSGTESVSTTISTGAGVSVVVAPHRTKHAILSASEGRMRVR
IPD080Aac  (151) TLSYQFSFGQSGTESVSTTISTGAGVSVVVAPHRTKHAILSASEGRMRVR
IPD080Aae  (151) TLSYQFSFGQSGTESVSTTISTGAGVSVVVAPHRTKHAILSASEGRMRVR
IPD080Aw   (151) TLSYQFSFGQSGTESVSTTISTGAGVSVVVAPHRTKHAILSASEGRMRVR
IPD080Az   (151) TLSYQFSFGQSGTESVSTTISTGAGVSVVVAPHRTKHAILSASEGRMRVR
IPD080Acd  (151) TLSYQFSFGQSGTESVSTTISTGAGVSVVVGPHRTKHAILSASEGRMRVR
IPD080Ace  (151) TLSYQFSFGQSRTESVSTTISTGAGVSVVVGPHRTKHAILSASEGRMRVR
IPD080Aam  (151) TLSYQFSFGQSGTESVSTTISTGAGVSVVVAPHRTKHAILSASEGRMRVR
IPD080Aan  (151) TLSYQFSFGQSGTESVSTTISTGAGVSVVVAPHRTKHAILSASEGRMRVR
IPD080Acq  (151) TLSYQFSFGQSGTESVSTTISTGAGVSVVVGPHRTKHAILSASEGRMRVR
IPD080Aba  (151) TLSYQFSFGQSGTESVSTTISTGAGVSVVVAPHRTKHAILSASEGRMRVR
IPD080Acn  (151) TLSYQFSFGQSGTESVSTTISTGAGVSVVVAPHRTKHAILSASEGRMRVR
```

Fig. 1K

```
IPD080Aco  (151)  TLSYQFSFGQSGTESVSTTISTGAGVSVVVAPHRTKHAILSASEGRMRVR
IPD080Acp  (151)  TLSYQFSFGQSGTESVSTTISTGAGVSVVVAPHRTKHAILSASEGRMRVR
IPD080Aca  (151)  TLSYQFSFGQSGTESVSTTISTGAGVSVVVAPHRTKHAILSASEGRMRVR
IPD080Ah   (151)  TLSYQFSFGQSGTESVSTTISTGAGVSVVVAPHRTKHAILSASEGRMRVR
IPD080Aag  (151)  TLSYQFSFGQSGTESVSTTISTGAGVSVVVAPHRTKHAILSASEGRMRVR
IPD080Ac   (151)  TLSYQFSFGQSGTESVSTTISTGAGVSVVVAPHRTKHAILIASEGRMRVR
IPD080Av   (151)  TLSYKFSFGQSGTESVSTTISTGAGVSVVVAPHRTKHAILSASEGRMRVR
IPD080Abk  (151)  TLSYQFSFGQSGTESVSTTISTGAGVSVVVGPHRTKHAILSASEGRMRVR
IPD080Abl  (151)  TLSYQFSFGQSGTESVSTTISTGAGVSVVVGPHRTKHAILSASEGRMRVR
IPD080Aq   (151)  TLSYQFSFGQSGTESVSTTISTGAGVSVVVAPHRTKHAILSASEGRMRVR
IPD080Abr  (151)  TLSYKFSFGQSGTESVSTTISTGAGVSVVVAPHRTKHAILSASEGRMRVR
IPD080Abs  (151)  TLSYKFSFGQSGTESVSTTISTGAGVSVVVAPHRTKHAILSASEGRMRVR
IPD080Am   (151)  TLSYKFSFGQSGTESVSTTISTGAGVSVVVAPHRTKHAILSASEGRMRVR
IPD080Aax  (151)  TLSYQFSFGQSGTESVSTTISTGAGVSVVVAPHRTKHAILSASEGRMRVR
IPD080Aay  (151)  TLSYQFSFGQSGTESVSTTISTGAGVSVVVAPHRTKHAILSASEGRMRVR
IPD080As   (151)  TLSYQFSFGQSGTESVSTTISTGAGVSVVVGPHRTKHAILSASEGRMRVR
IPD080Ag   (151)  TLSYEFSFGQSGTESVSTTISTGAGVSVVVGPHRTKHAILSASEGRMRVR
IPD080Abe  (151)  TLSYQFSFGQSGTESVSTTISTGAGVSVVVGPHRTKHAILSASEGRMRVR
IPD080Abf  (151)  TLSYQFSFGQSGTESVSTTISTGAGVSVVVGPHRTKHAILSASEGRMRVR
IPD080Abg  (151)  TLSYQFSFGQSGTESVSTTVSTGAGVSVVVGPHRTKHAILSASEGRMRVR
IPD080Acl  (151)  TLSYQFSFGQSGTESVSTTISTGAEVSVVVGPHRTKHAILSASEGRMRVR
IPD080Acm  (151)  TLSYQFSFGQSGTESVSTTISTGAGVSVVVGPHRTKHAILSASEGRMRVR
IPD080Ak   (151)  TLSYQFSFGQSGTESVSTTISTGAGVSVVVGPHRTKHAILSASEGRMRVR
IPD080Al   (151)  TLSYQFSFGQSGTESVSTTISTGAGVSVVVGPHRTKHAILSASEGRMRVR
IPD080Ap   (151)  TLSYQFSFGQSGTESVSTTISTGAGVSVVVGPHRTKHAILSASEGRMRVR
IPD080Aat  (151)  TLSYQFSFGQSGTESVSTTISTGAGVSVVVGPHRTKHAILSASEGRMRVR
IPD080Aau  (151)  TLSYQFSFGQSGTESVSTTISTGAGVSVVVGPHRTKHAILSASEGRMRVR
IPD080Aaw  (151)  TLSYQFSFGQSGTESVSTTISTGAGVSVVVGPHRTKHAILSASEGRMRVR
IPD080Aaz  (151)  TLSYQFSFGQSGTESVSTTISTGAGVSVVVGPHRTKHAILSASEGRMRVR
IPD080Ack  (151)  TLSYQFSFGQSGTESVSTTISTGAGVSVVVGPHRTKHAILSASEGRMRVR
IPD080Aj   (151)  TLSYQFSFGQSGTESVSTTISTGAGVSVVVGPHRTKHAILSASEGRMRVR 201                                            250
IPD080Aa   (201)  IRYEAYLTGSTAVNYNPRHNGHHFWGLGIAGVMRSGNISNTRTITEDISL
IPD080Abj  (201)  IRYEAYMTGSTAVNYNPRHNGHHFWGLGIAGVMRSGNISNTRTITEDISL
IPD080Ai   (201)  IRYEAYMTGSTAVNYNPRHNGHHFWGLGIAGVMRSGNISNTRTITEDISL
IPD080Acf  (201)  IRYEAYMTGSTAVNYNPRHNGHHFWGLGIAGVMRSGNISNTRTITEDISL
IPD080An   (201)  IRYEAYMTGSTAVNYNPRHNGHHFWGLGIAGVMRSGNISNTRTITEDISL
IPD080Acy  (201)  IRYEAYLTGSTAVNYNPRHNGHHFWGLGIAGVMRSGNISNTRTITGS----
IPD080Adb  (201)  IRYEAYLTGSTAVNYNPRHNGHHFWGLGIAGVMRSGNISNTRTITGS----
IPD080Adg  (201)  IRYEAYLTGSTAVNYNPRHNGHHFWGLGIAGVMRSGNISNTRTITGS----
IPD080Ada  (201)  IRYEAYLTGSTAVNYNPRHNGHHFWGLGIAGVMRSGNISNTRTITGS----
IPD080Adh  (201)  IRYEAYLTGSTAVNYNPRHNGHHFWGLGIAGVMRSGNISNTRTITGS----
IPD080Acz  (201)  IQYEAYLTGSTAVNYNPRHNGHHFWGLGIAGVMRSGNISNTRTITGS----
IPD080Ade  (201)  IQYEAYLTGSTAVNYNPRHNGHHFWGLGIAGVMRSGNISNTRTITGS----
IPD080Adc  (201)  IRYEAYLTGSTAVNYNPRHNGHHFWGLGIAGVMRSGNISNTRTITGS----
IPD080Adf  (201)  IRYEAYLTGSTAVNYNPRHNGHHFWGLGIAGVMRSGNISNTRTITGS----
IPD080Adi  (201)  IRYEAYLTGSTAVNYNPRHNGHHFWGLGIAGVMRSGNISNTRTITGS----
```

Fig. 1L

```
IPD080Adj  (201) IRYEAYLTGSTPVNYNPRHDGHHFWGLGIAGVMRSGNISNTRTITGS----
IPD080Adk  (201) IRYEAYLTGSTAVNYNPRHNGHHFWGLGIAGVMRSGNISNTRTITGS----
IPD080Bf   (201) ITYEVYLTGSTAVNYNPRHNGHHFWGLGIAGVMRSGNISSTRTITEDITL
IPD080Bg   (201) ITYEVYLTGSTAVNYNPRHNGHHFWGLGIAGVMRSGNISSTRTITEDITL
IPD080Bi   (201) ITYEVYLTGSTAVNYNPRHNGHHFWGLGIAGVMRSGNISSTRTITEDITL
IPD080Bh   (201) ITYEVYLTGSTAVNYNPRHNGHHFWGLGIAGVMRSGNISSTRTITEDITL
IPD080Bj   (201) ITYEVYLTGSTAVNYNPRHNGHHFWGLGIAGVMRSGNISSTRTITEDITL
IPD080Bk   (201) ITYEVYLTGSTAVNYNPRHNGHHFWGLGISGVMRSGNISNTRTITEDVTL
IPD080Bn   (201) ITYEVYLTGSTAVNYNPRHNGHHFWGLGISGVMRSGNISNTRTITEDVTL
IPD080Bm   (201) ITYEVYLTGSTAVNYNPRHNGHHFWGLGISGVMRSGNISNTRTITEDVTL
IPD080Bl   (201) ITYEVYLTGSTAVNYNPRHNGHHFWGLGISGVMRSGNISNTRTITEDVTL
IPD080Bo   (201) ITYEVYLTGSTAVNYNPRHNGHHFWGLGISGVMRSGNISNTRTITEDVTL
IPD080Aah  (201) IRYEAYMTGSTAVNYNPRHNGHHFWGLGIAGVMRSGNISNTRTITEDISL
IPD080Abp  (201) IRYEAYMTGSTAVNYNPRHRGHHFWGLGIAGVMRSGNISNTRTITEDISL
IPD080Abq  (201) IRYEAYMTGSTAVNYNPRHRGHHFWGLGIAGVMRSGNISNTRTITEDISL
IPD080Abw  (201) IRYEAYMTGSTAVNYNPRHRGHHFWGLGIAGVMRSGNISNTRTITEDISL
IPD080Abx  (201) IRYEAYMTGSTAVNYNPRHRGHHFWGLGIAGVMRSGNISNTRTITEDISL
IPD080Abi  (201) IRYEAYLTGSTAVNYNPRHRGHHFWGLGIAGVMRSGNISNTRTITEDISL
IPD080Ach  (201) IRYEAYLTGSTAVNYNPRHRGHHFWGLGIAGVMRSGNISNTRTITEDISL
IPD080Ae   (201) IRYEAYLTGSTAVNYNPRHRGHHFWGLGIAGVMRSGNISNTRTITEDISL
IPD080At   (201) IRYEAYLTGSTAVNYNPRHRGHHFWGLGIAGVMRSGNISNTRTITEDISL
IPD080Acu  (201) IRYEAYLTGSTAVNYNPRHRGHHFWGLGIAGVMRSGNISNTRTITEDISL
IPD080Af   (201) IRYEAYLTGSTAVNYNPRHRGHHFWGLGIAGVMRSGNISNTRTITEDISL
IPD080Aaa  (201) IRYEAYLTGSTAVNYNPPHRGHHFWGLGIAGVMRSGNISNTRTITEDISL
IPD080Ar   (201) IRYEAYLTGSTAVNYNPPHRGHHFWGLGIAGVMRSGNISNTRTITEDISL
IPD080Ax   (201) IRYEAYLTGSTAVNYNPRHRGHHFWGLGITGVMRSGNISNTRTITEDISL
IPD080Abh  (201) IRYEAYLTGSTAVNYNPRHRGHHFWGLGIAVMRSGNISNTRTITEDISL
IPD080Acv  (201) IRYEAYLTGSTAVNYNPRHRGHHFWGLGIAGVMRSGNISNTRTITEDISL
IPD080Acx  (201) IRYEAYLTGSTAVNYNPRHRGHHFWGLGIAGVMRSGNISNTRTITEDISL
IPD080Acw  (201) IRYEAYLTGSTAVNYNPRHRGHHFWGLGIAGVMRSGNISNTRTITEDISL
IPD080Acr  (201) IRYEAYLTGSTAVNYNPRHRGHHFWGLGIAGVMRSGNISNTRTITEDISL
IPD080Acs  (201) IRYEAYLTGSTAVNYNPRHRGHHFWGLGIAGVMRSGNISNTRTITEDISL
IPD080Act  (201) IRYEAYLTGSTAVNYNPRHRGHHFWGSGIAGVMRSGNISNTRTITEDISL
IPD080Aaf  (201) IRYEAYLTGSTAVNYNPRHRGHHFWGLGIAGVMRSGNISNTRTITEDISL
IPD080Aak  (201) IRYEAYLTGSTAVNYNPRHRGHHFWGLGIAGVMRSGNISNTRTITEDISL
IPD080Ay   (201) IRYEAYLTGSTAVNYNPRHRGHHFWGLGIAGVMRSGNISNTRTITEDISL
IPD080Abt  (201) IRYEAYLTGSTAVNYNPRHRGHHFWGLGIAGVMRSGNISNTRTITEDISL
IPD080Abu  (201) IRYEAYLTGSTAVNYNPRHRGHHFWGLGIAGVMRSGNISNTRTITEDISL
IPD080Abv  (201) IRYEAYLTGSTAVNYNPRHRGHHFWGLGIAGVMRSGNISSTRTITEDISL
IPD080Aad  (201) IRYEAYLTGSTAVNYNPRHRGHHFWGLGIAGVMRSGNISNTRTITEDISL
IPD080Au   (201) IRYEAYLTGSTAVNYNPRHRGHHFWGLGIAGVMRSGNISNTRTITEDISL
IPD080Acb  (198) IRYEAYLTGSTAVNYNPRHRGHHFWGLGIAGVMRSGNISNTRTITEDISL
IPD080Acc  (198) IRYEAYLTGSTAVNYNPRHRGHHFWGLGIAGVMRSGNISNTRTITEDISL
IPD080Bb   (199) IRYEAYLTGSTAVNYNPRHRGHHFWGLGIDGVMRSGNISNTRTITEDISL
IPD080Be   (199) IRYEAYLTGSTAVNYNPRHRGHHFWGLGIDGVMRSGNISNTRTITEDISL
IPD080Aav  (201) IRYEAYLTGSTAVNYNPRHRGHHFWGLGIAGVMRSGNISNTRTITEDISL
IPD080Aab  (201) IRYEAYLTGSTAVNYNPRHRGHHFWGLGIAGVMRSGNISNTRTITEDISL
IPD080Aal  (201) IRYEAYLTGSTAVNYNPRHRGHHFWGLGIAGVMRSGNISNTRTITEDISL
IPD080Aai  (201) IRYEAYLTGSTAVNYNPRHRGHHFWGLGIAGVMRSGNISNTRTITEDISL
```

Fig. 1M

```
IPD080Aaj  (201)  IRYEAYLTGSTAVNYNPRHRGHHFWGLGIAGVMRSGNISNTRTITEDISL
IPD080Aao  (201)  IRYEAYLTGSTAVNYNPRHRGHHFWGLGIAGVMRSGNISNTRTITEDISL
IPD080Aar  (201)  IRYEAYLTGSTAVNYNPRHRGHHFWGLGIAGVMRSGNISNTRTITEDISL
IPD080Abc  (201)  IRYEAYLTGSTAVNYNPRHRGHHFWGLGIAGVMRSGDISNTRTITEDISL
IPD080Abd  (201)  IRYEAYLTGSTAVNYNPRHRGHHFWGLGIAGVMRSGNISNTRTITEDISL
IPD080Acg  (201)  IRYEAYLTGSTAVNYNPRHRGHHFWGLGIAGVMRSGNISNTRTITEDISL
IPD080Ab   (201)  IRYEAYLTGSTAVNYNPRHRGHHFWGLGIAGVMRSGNISNTRTITEDISL
IPD080Aby  (201)  IRYEAYLTGSTAVNYNPRHRGHRFWGLGIAGVMRSGNISNTRTITEDISL
IPD080Abz  (201)  IRYEAYLTGSTAVNYNPRHRGHHFWGLGIAGVMRSGNISNTRTITEDISL
IPD080Aaq  (201)  IRYEAYLTGSTAVNYNPRHRGHHFWGLGIAGVMRSGNISNTRTITEDISL
IPD080Aas  (201)  IRYEAYLTGSTAVNYNPRHRGHHFWGLGIAGVMRSGNISNTRTITEDISL
IPD080Ad   (201)  IRYEAYLTGSTAVNYNPRHRGHHFWGLGIAGVMRSGNISNTRTITEDISL
IPD080Ba   (201)  IRYEAYLTGSTAVNYNPRHRGHHFWGLGIAGVMRSGNISNTRTITEDISL
IPD080Bc   (201)  IRYEAYLTGSTAVNYNPRHRGHHFWGLGIAGVMRSGNISNTRTITEDISL
IPD080Bd   (201)  IRYEAYLTGSTAVNYNPRHRGHHFWGLGIAGVMRSGNISNTRTITEDISL
IPD080Aci  (201)  IRYEAYLTGSTAVNYNPRHRGHHFWGLGIAGVMRSGNISNTRTITEDISL
IPD080Acj  (201)  IRYEAYLTGSTAVNYNPRHRGHHFWGLGIAGVMRSGNISNTRTITEDISL
IPD080Aap  (201)  IRYEAYLTGSTAVNYNPRHRGHHFWGLGIAGVMRSGNISNTRTITEDISL
IPD080Abm  (201)  IRYEAYLTGSTAVNYNPRHRGHHFWGLGIAGVMRSGNISNTRTITEDISL
IPD080Abn  (201)  IRYEAYLTGSTAVNYNPRHRGHHFWGLGIAGVMRSGNISNTRAITEDISL
IPD080Abo  (201)  IRYEAYLTGSTAVNYNPRHRGHHFWGLGIAGVMRSGNISNTRTITEDISL
IPD080Ao   (201)  IRYEAYLTGSTAVNYNPRHRGHHFWGLGIAGVMRSGNISNTRTITEDISL
IPD080Aac  (201)  IRYEAYLTGSTAVNYNPRHRGHHFWGLGIAGVMRSGNISNTRTITEDISL
IPD080Aae  (201)  IRYEAYLTGSTAVNYNPRHRGHHFWGLGIAGVMRSGNISNTRTITEDISL
IPD080Aw   (201)  IRYEAYLTGSTAVNYNPRHRGHHFWGLGIAGVMRSGNISNTRTITEDISL
IPD080Az   (201)  IRYEAYLTGSTAVNYNPRHRGHHFWGLGIAGVMRSGNISNTRTITEDISL
IPD080Acd  (201)  IRYEAYLTGSTAVNYNPRHRGHHFWGLGIAGVMRSGNISNTRTITEDISL
IPD080Ace  (201)  IRYEAYLTGSTAVNYNPRHRGHHFWGLGIAGVMRSGNISNTRTITEDISL
IPD080Aam  (201)  IRYEAYLTGSTAVNYNPRHRGHHFWGLGIAGVMRSGNISNTRTITEDISL
IPD080Aan  (201)  IRYEAYLTGSTAVNYNPRHRGHHFWGLGIAGVMRSGNISNTRTITEDISL
IPD080Acq  (201)  IRYEAYLTGSTAVNYNPRHRGHHFWGLGIAGVMRSGNISNTRTITEDISL
IPD080Aba  (201)  IRYEAYLTGSTAVNYNPRHRGHHFWGLGIAGVMRSGNISNTRTITEDISL
IPD080Acn  (201)  IRYEAYLTGSTAVNYNPRHRGHHFWGLGIAGVMRSGNISNTRTITEDISL
IPD080Aco  (201)  IRYEAYLTGSTAVNYNPRHRGHHFWGLGIAGVMRSGNISNTRTITEDISL
IPD080Acp  (201)  IRYEAYLTGSTAVNYNPRHRGHHFWGLGIAGVMRNGNISNTRTITEDISL
IPD080Aca  (201)  IRYEAYLTGSTAVNYNPRHRGHHFWGLGIAGVMRSGNISNTRTITEDISL
IPD080Ah   (201)  IRYEAYLTGSTAVNYNPRHRGHHFWGLGIAGVMRSGNISNTRTITEDISL
IPD080Aag  (201)  IRYEAYLTGSTAVNYNPRHRGHHFWGLGIAGVMRSGNISNTRTITEDISL
IPD080Ac   (201)  IRYEAYLTGSTAVNYNPRHRGHHFWGLGIAGVMRSGNISNTRTITEDISL
IPD080Av   (201)  IRYEAYLTGSTAVNYNPRHRGHHFWGLGIAGVMRSGNISNTRTITEDISL
IPD080Abk  (201)  IRYEAYLTGSTAVNYNPRHRGHHFWGLGIAGVMRSGNISNTRTITEDISL
IPD080Abl  (201)  IRYEAYLTGSTAVNYNPRHRGHHFWGLGIAGVMRSGNISNTRTITEDISL
IPD080Aq   (201)  IRYEAYLTGSTAVNYNPRHRGHHFWGLGIAGVMRSGNISNTRTITEDISL
IPD080Abr  (201)  IRYEAYLTGSTAVNYNPRHRGHHFWGLGTAGVMRSGDISNTRTITEDISL
IPD080Abs  (201)  IRYEAYLTGSTAVNYNPRHRGHHFWGLGIAGVMRSGNISNTRTITEDISL
IPD080Am   (201)  IRYEAYLTGSTAVNYNPRHRGHHFWGLGIAGVMRSGNISNTRTITEDISL
IPD080Aax  (201)  IRYEAYLTGSTAVNYNPRHRGHHFWGLGIAGVMRSGNISNTRTITEDISL
IPD080Aay  (201)  IRYEAYLTGSTAVNYNPRHRGHHFWGLGIAGVMRSGNISNTRTITEDISL
IPD080As   (201)  IRYEAYLTGSTAVNYNPRHRGHHFWGLGIAGVMRSGNISNTRTITEDISL
```

Fig. 1N

```
IPD080Ag  (201) IRYEAYLTGSTAVNYNPRHRGHHFWGLGIAGVMRSGNISNTRTITEDISL
IPD080Abe (201) IRYEAYLTGSTAVNYNPRHRGHHFWGLGIAGVMRSGNISNTRTITEDISL
IPD080Abf (201) IRYEAYLTGSTAVNYNPRHRGHHFWGLGIAGVMRSGNISNTRTITEDISL
IPD080Abg (201) IRYEAYLTGSTAVNYNPRHRGHHFWGLGIAGVMRSGNISNTRTITEDISL
IPD080Acl (201) IRYEAYLTGSTAVNYNPRHRGHHFWGLGIAGVMRSGNISNTRTITEDISL
IPD080Acm (201) IRYEAYLTGSTAVNYNPRHRGHHFWGLGIAGVMRSGNISNTRTITEDISL
IPD080Ak  (201) IRYEAYLTGSTAVNYNPRHRGHHFWGLGIAGVMRSGNISNTRTITEDISL
IPD080Al  (201) IRYEAYLTGSTAVNYNPRHRGHHFWGLGIAGVMRSGNISNTRTITEDISL
IPD080Ap  (201) IRYEAYLTGSTAVNYNPRHRGHHFWGLGIAGVMRSGNISNTRTITEDISL
IPD080Aat (201) IRYEAYLTGSTAVNYNPRHRGHHFWGLGIAGVMRSGNISNTRTITEDISL
IPD080Aau (201) IRYEAYLTGSTAVNYNPRHRGHHFWGLGIAGVMRSGNISNTRTITEDISL
IPD080Aaw (201) IRYEAYLTGSTAVNYNPRHRGHHFWGLGIAGVMRSGNISNTRTITEDISL
IPD080Aaz (201) IRYEAYLTGSTAVNYNPRHRGHHFWGLGIAGVMRSGNISNTRTITEDISL
IPD080Ack (201) IRYEAYLTGSTAVNYNPRHRGHHFWGLGIAGVMRSGNISNTRTITEDISL
IPD080Aj  (201) IRYEAYLTGSTAVNYNPRHRGHHFWGLGIAGVMRSGNISNTRTITEDISL 251                                            300
IPD080Aa  (251) QSYSNGSVVLGEGPAPISLVEAVETLNEKATAPIP---------EPLEEEEE
IPD080Abj (251) QSYSNSSVVLGEGPAPISLVEAVETLNEKATAPPPVVESI--PMEEEEEE
IPD080Ai  (251) QSYSNSSVVLGEGPAPISLVEAVETLNEKATAPPPVVESI--PMEEEEEE
IPD080Acf (251) QSYSNSSVVLGEGPAPISLVEAVETLNEKATAPPPVVESI--PMEEEEEE
IPD080An  (251) QSYSNSSVVLGEGPAPISLVEAVETLNEKATAPPPVVESI--PMEEEEEE
IPD080Acy (251) --------------------------------------------------
IPD080Adb (251) --------------------------------------------------
IPD080Adg (251) --------------------------------------------------
IPD080Ada (251) --------------------------------------------------
IPD080Adh (251) --------------------------------------------------
IPD080Acz (251) --------------------------------------------------
IPD080Ade (251) --------------------------------------------------
IPD080Adc (251) --------------------------------------------------
IPD080Adf (251) --------------------------------------------------
IPD080Adi (251) --------------------------------------------------
IPD080Adj (251) --------------------------------------------------
IPD080Adk (251) --------------------------------------------------
IPD080Bf  (251) QSYSNGSIVLGEGPAPSPVVEEVETLEKEK-------EK----KGS------
IPD080Bg  (251) QSYSNGSIVLGEGPAPSPVVEEVETLEKEK-------EK----KGS------
IPD080Bi  (251) QSYSNGSIVLGEGPAPSPGVEEIETLEKEK-------EK----KGS------
IPD080Bh  (251) QSYSNGSIVLGEGPAPSPVVEEVEKLEKEK-------EK----KGS------
IPD080Bj  (251) QSYSNGSIVLGEGPAPSPVVEEVEKLEKEK-------EK----KGS------
IPD080Bk  (251) QSYSNGSIVLGEGPAPSAVVEAVETLEKEQEKEKEK-----KGS------
IPD080Bn  (251) QSYSNGSIVLGEGPAPSAVVEAVETLEKEQEKEKEKEKEKEKKGS-----
IPD080Bm  (251) QSYSNGSIVLGEGPAPSAVVEAVETLEKEQ---EKEKEK------KGS----
IPD080Bl  (251) QSYSNGSIVLGEGPAPSPVVEAVETLEKEK--EKEKEK----KGS-------
IPD080Bo  (251) QSYSNGSIVLGEGPAPSAVVEAVETLEKEK--ERERER----KGS-------
IPD080Aah (251) QSYSNGRVLLEEGPAPISLVEEVTTLNEKATAPIPVIEST--EPLEEEEE
IPD080Abp (251) QSYSNGRVLLEEGPAPISLVEEVTTLNEKATAPIPVIEST--EPLEEEEE
IPD080Abq (251) QSYSNGRVLLEEGPAPISLVEEVTTLNEKATAPIPVIEST--EPLEEEEE
IPD080Abw (251) QSYSNGSVVLGEGPAPISLVEEVTTLNEKATAPIPVIEST--EPLEEEEE
```

Fig. 1O

```
IPD080Abx   (251)  QSYSNGSVVLGEGPAPISLVEEVTTLNEKATAPIPVIEST---EPLEEEEE
IPD080Abi   (251)  LSYSNGSVVLGEGPAPLSLVEEVKTLNEKATAPIPVIEST---EPLEEEEE
IPD080Ach   (251)  LSYSNGSVVLGEGPAPLSLVEEVKTLNEKATAPIPVIEST---EPLEEEEE
IPD080Ae    (251)  QSYSNGSIVLGEGPAPISLVEEVKTLNEKATAPIPVIEST---EPLEEEEE
IPD080At    (251)  QSYSNGSIVLGEGPAPISLVEEVKTLNEKATAPIPVIEST---EPLEEEEE
IPD080Acu   (251)  QSYSNGSIVLGEGPAPISLVEEVKTLNEKATAPIPVIEST---EPLEEEEE
IPD080Af    (251)  QSYSNGSIVLGEGPAPISLVEEVKTLNEKATAPIPVIEST---EPLEEEEE
IPD080Aaa   (251)  LSYSNGSVVLGEGPAPLSLVEEVKTLNEKATAPIPVIEST---EPLEEEEE
IPD080Ar    (251)  LSYSNGSVVLGEGPAPLSLVEEVKTLNEKATAPIPVIEST---EPLEEEEE
IPD080Ax    (251)  LSYSNGSVVLGEGPAPLSLVEEVKTLNEKATAPIPVIEST---EPLEEEEE
IPD080Abh   (251)  LSYSNGSVVLGEGPAPLSLVEEVKTLNEKATAPIPVIEST---EPLEEEEE
IPD080Acv   (251)  LSYSNGSVVLGEGPAPLSLVEEVKTLNEKATAPIPVIEST---EPLEEEEE
IPD080Acx   (251)  LSYSNGSVVLGEGPAPLSLVEEVKTLNEKATAPIPVIEST---EPLEEEEE
IPD080Acw   (251)  LSYSNGSVVLGEGPAPLSLVDEVKTLNEKATAPIPVLEST---EPLEEEEE
IPD080Acr   (251)  LSYSNGSVVLGEGPAPLSLVEEVKTLNEKATAPIPVIGST---EPLEEEEE
IPD080Acs   (251)  LSYSNGSVVLGEGPAPLSLVEEVKTLNEKATAPIPVIEST---EPLEEEEE
IPD080Act   (251)  LSYSNGSVVLGEGPAPLSLVEEVKTLNEKATAPIPVIEST---EPLEEEEE
IPD080Aaf   (251)  LSYSNGSVVLGEGPAPLSLVEEVKTFNEKATAPIPVIEST---ELLEEEEE
IPD080Aak   (251)  LSYSNGSVVLGEGPAPLSLVEEVKTLNEKATAPIPVIEST---ELLEEEEE
IPD080Ay    (251)  LSYSNGSVVLGEGPAPLSLVEEVKTLNEKATAPIPVIEST---ELLEEEEE
IPD080Abt   (251)  LSYSNGSVVLGEGPAPLSLVEEVKTLNEKATAPIPVIEST---EPLEEEEE
IPD080Abu   (251)  LSYSNGSVVLGEGPAPLSLVEEVKTLNEKATAPIPVIEST---EPLEEEEE
IPD080Abv   (251)  LSYSNGSVVLGEGPAPLSLVEEVKTLNEKATAPIPVIEST---EPLEEEEE
IPD080Aad   (251)  QSYSNGSVVLGEGPAPISLVEEVTTLNEKATAPIPVIEST---EPLEEEEE
IPD080Au    (251)  QSYSNGSVVLGEGPAPISLVEEVTTLNEKATAPIPVIEST---EPLEEEEE
IPD080Acb   (248)  QSYSNGSIVLGEGPAPISLVEEVKTLNEKATAPIPVIEST---EPLEEEEE
IPD080Acc   (248)  QSYSNGSIVLGEGPAPISLVEEVKTLNEKATAPIPVIEST---EPLEEEEE
IPD080Bb    (249)  HSYSNGSVVFGEGPAPLSLVEEVKTLNEKATTPIPVIEST---EPLEEEEE
IPD080Be    (249)  HSYSNGSVVFGEGPAPLSLVEEVKTLNEKATTPIPVIEST---EPLEEEEE
IPD080Aav   (251)  LSYSNGSVVLGEGPAPLSLVEEVKTLNEKATAPIPVIEST---EPLEEEEE
IPD080Aab   (251)  QSYSNGSVVLGEGPAPISLVEEVTTLNEKATAPIPVIEST---EPLEEEEE
IPD080Aal   (251)  QSYSNGSVVLGEGPAPISLVEEVTTLNEKATAPIPVIEST---EPLEEEEE
IPD080Aai   (251)  QSYSNGRVVLEEGPAPISLVEEVTTLNEKATAPIPVIEST---EPLEEEEE
IPD080Aaj   (251)  QSYSNGRVVLEEGPAPISLVEEVTTLNEKATAPIPVIEST---EPLEEEEE
IPD080Aao   (251)  QSYSNGRVLLEEGPAPISLVEEVTTLNEKATAPIPVIEST---EPLEEEEE
IPD080Aar   (251)  QSYSNGRVLLEEGPAPISLVEEVTTLNEKATAPIPVIEST---EPLEEEEE
IPD080Abc   (251)  QSYSNGRVLLEEGPAPISLVEEVTTLNEKATAPIPVIEST---EPLEEEEE
IPD080Abd   (251)  QSYSNGRVLLEEGPAPISLVEEVTTLNEKATAPIPVIEST---EPLEEEEE
IPD080Acg   (251)  QSYSNGRVVLEEGPAPISLVEEVTTLNEKATAPIPVIEST---EPLEEEEE
IPD080Ab    (251)  QSYSNGRVLLEEGPAPISLVEEVTTLNEKATAPIPVIEST---EPLEEEEE
IPD080Aby   (251)  QSYSNGRVVLEEGPAPISLVEEVTTLNEKATAPIPVIEST---EPLEEEEE
IPD080Abz   (251)  QSYSNGRVVLEEGPAPISLVEEVTTLNEKATAPIPVIEST---EPLEEEEE
IPD080Aaq   (251)  QSYSNGSIVLGEGPAPISLVEEVKTLNEKATAPIPVIEST---EPLEEEEE
IPD080Aas   (251)  QSYSNGSVVLGEGPAPISLVEEVTTLNEKATAPIPVIEST---EPLEEEEE
IPD080Ad    (251)  QSYSNGRVVLEEGPAPISLVEEVTTLNEKATAPIPVIEST---EPLEEEEE
IPD080Ba    (251)  QSYSNGRVLLEEGPAPISLVEEVTTLNEKATAPIPVIEST---EPLEEEEE
IPD080Bc    (251)  QSYSNGRVLLEEGPAPISLVEEVTTLNEKATAPIPVIEST---EPLEEEEE
IPD080Bd    (251)  QSYSNGRVLLEEGPAPISLVEEVTTLNEKATAPIPVIEST---EPLEEEEE
IPD080Aci   (251)  QSYSNGSIVLGEGPAPISLVEEVKTLNEKATAPIPVIEST---EPLEEEEE
```

Fig. 1P

```
IPD080Acj  (251)  QSYSNGSIVLGEGPAPISLVEEVKTLNEKATAPIPVIEST---EPLEEEEE
IPD080Aap  (251)  LSYSNGSVVLGEGPAPISLVEEVKTLNEKATAPIPVIEST---ELLEEEEE
IPD080Abm  (251)  QSYSNGSIVLGEGPAPISLVEEVKTLNEKATAPIPVIEST---EPLEEEEE
IPD080Abn  (251)  QSYSNGSIVLGEGPAPISLVEEVKTLNEKATAPIPVIEST---EPLEEEEE
IPD080Abo  (251)  QSYSNGSIVLGEGPAPISLVEEVKTLNEKATAPIPVIEST---EPLEEEEE
IPD080Ao   (251)  QSYSNGSVVLGEGPAPISLVEEVTTLNEKATAPIPVIEST---EPLEEEEE
IPD080Aac  (251)  QSYSNGSIVLGEGPAPISLVEEVKTLNEKATAPIPVIEST---EPLEEEEE
IPD080Aae  (251)  QSYSNGSIVLGEGPAPISLVEEVKTLNEKATAPIPVIEST---EPLEEEEE
IPD080Aw   (251)  QSYSNGSIVLGEGPAPISLVEEVKTLNEKATAPIPVIEST---EPLEEEEE
IPD080Az   (251)  QSYSNGSIVLGEGPAPISLVEEVKTLNEKATAPIPVIEST---EPLEEEEE
IPD080Acd  (251)  QSYSNGSIVLGEGPAPISLVEEVKTLNEKATAPIPVIEST---EPLEEEEE
IPD080Ace  (251)  QSYSNGSIVLGEGPAPISLVEEVKTLNEKATAPIPVIEST---EPLEEEEE
IPD080Aam  (251)  QSYSNGSIVLGEGPAPISLVEEVKTLNEKATAPIPVIEST---EPLEEEEE
IPD080Aan  (251)  QSYSNGSIVLGEGPAPISLVEEVKTLNEKATAPIPVIEST---EPLEEEEK
IPD080Acq  (251)  QSYSNGSVVLGEGPAPISLVEEVKTLNEKATAPIPVIEST---EPLEEEEE
IPD080Aba  (251)  QSYSNGSIVLGEGPAPISLVEEVKTLNEKATAPIPVIEST---EPLEEEEE
IPD080Acn  (251)  QSYSNGRVVLGEGPAPLSLVEEVKTLNEKATAPIPVIEST---EPLEEEEE
IPD080Aco  (251)  QSYSNGSVVLGEGPAPLSLVEEVKTLNEKATAPIPVIEST---EPSEEEEE
IPD080Acp  (251)  QSYSNGSVVLGEGPAPLSLVEEVKTLNEKATAPIPVIEST---EPLEEEEE
IPD080Aca  (251)  QSYSNGSIVLGEGPAPISLVEEVKTLNEKATAPIPVIEST---EPLEEEEE
IPD080Ah   (251)  QSYSNGSIVLGEGPAPISLVEEVKTLNEKATAPIPVIEST---EPLEEEEE
IPD080Aag  (251)  QSYSNGRVLLEEGPAPISLVEEVTTLNEKATAPIPVIEST---EPLEEEEE
IPD080Ac   (251)  QSYSNGRVLLEEGPAPISLVEEVTTLNEKATAPIPVIEST---EPLEEEEE
IPD080Av   (251)  QSYSNGRVLLEEGPAPISLVEEVTTLNEKATAPIPVIEST---EPLEEEEE
IPD080Abk  (251)  QSYSNGRVLLEEGPAPISLVEEVTTLNEKATAPIPVIEST---EPLEEEEE
IPD080Abl  (251)  QSYSNGRVLLEEGPAPISLVEEVTTLNEKATAPIPVIEST---EPLEEEEE
IPD080Aq   (251)  QSYSNGRVLLEEGPAPISLVEEVTTLNEKATAPIPVIEST---EPLEEEEE
IPD080Abr  (251)  QSYSNGRVLLEEGPAPISLVEEVTTLNEKATAPIPVIEST---EPLEEEEE
IPD080Abs  (251)  QSYSNGRVLLEEGPAPISLVEEVTTLNEKATAPIPVIEST---EPLEEEEE
IPD080Am   (251)  QSYSNGRVVLEEGPAPISLVEEVTTLNEKATAPIPVIEST---EPLEEEEE
IPD080Aax  (251)  QSYSNGRVPLEEGPAPISLVEEVTTLNEKATAPIPVIEST---EPLEEEEE
IPD080Aay  (251)  QSYSNGRVLLEEGPAPISLVEEVTTLNEKATAPIPVIEST---EPLEEEEE
IPD080As   (251)  QSYSNGRVLLEEGPAPISLVEEVTTLNEKATAPIPVIEST---EPLEEEEE
IPD080Ag   (251)  QSYSNGSIVLGEGPAPISLVEEVTTLNEKATAPIPVIEST---EPLEEEEE
IPD080Abe  (251)  QSYSNGSVVLGEGPAPISLVEEVTTLNEKATAPIPVIEST---EPLEEEEE
IPD080Abf  (251)  QSYSNGSVVLGEGPAPISLVEEVTTLNEKATAPIPVIEST---EPLEEEEE
IPD080Abg  (251)  QSYSNGSVVLGEGPAPISLVEEVTTLNEKATAPIPVIEST---EPLEEEEE
IPD080Acl  (251)  QSYSNGSVVLGEGPAPISLVEEVTTLNEKATAPIPVIEST---EPLEEEEE
IPD080Acm  (251)  QSYSNGSVVLGEGPAPISLVEEVTTLNEKATAPIPVIEST---EPLEEEEE
IPD080Ak   (251)  QSYSNGSVVLGEGPAPISLVEEVTTLNEKATAPIPVIEST---EPLEEEEE
IPD080Al   (251)  QSYSNGSVVLGEGPAPISLVEEVTTLNEKATAPIPVIEST---EPLEEEEE
IPD080Ap   (251)  QSYSNGSVVLGEGPAPISLVEEVTTLNEKATAPIPVIEST---EPLEEEEE
IPD080Aat  (251)  QSYSNGSVVLGEGPAPISLVEEVTTLNEKATAPIPVIEST---EPLEEEEE
IPD080Aau  (251)  QSYSNGSVVLGEGPAPISLVEEVTTLNEKATAPIPVIEST---EPLEEEEE
IPD080Aaw  (251)  QSYSNGSVVLGEGPAPISLVEEVTTLNEKATAPIPVIEST---EPLEEEEE
IPD080Aaz  (251)  QSYSNGSVVLGEGPAPISLVEEVTTLNEKATAPIPVIEST---EPLEEEEE
IPD080Ack  (251)  QSYSNGSVVLGEGPAPISLVEEVTTLNEKATAPIPVIEST---EPLEEEEE
IPD080Aj   (251)  QSYSNGSVVLGEGPAPISLVEEVTTLNEKATAPIPVIEST---EPLEEEEE
```

Fig. 1Q

| | | 301 | | | 301 | | | 301 |
|---|---|---|---|---|---|---|---|---|
| IPD080Aa | (294) | EKKE | IPD080Acs | (299) | EKKE | IPD080Aam | (299) | EKKE |
| IPD080Abj | (299) | EKKE | IPD080Act | (299) | EKKE | IPD080Aan | (299) | RRR- |
| IPD080Ai | (299) | EKKE | IPD080Aaf | (299) | KKE- | IPD080Acq | (299) | EKKE |
| IPD080Acf | (299) | EKKE | IPD080Aak | (299) | KKE- | IPD080Aba | (299) | EKKE |
| IPD080An | (299) | EKKE | IPD080Ay | (299) | KKE- | IPD080Acn | (299) | EKKE |
| IPD080Acy | (256) | | IPD080Abt | (299) | ENKE | IPD080Aco | (299) | EKKE |
| IPD080Adb | (260) | | IPD080Abu | (299) | ENKE | IPD080Acp | (299) | EKKE |
| IPD080Adg | (258) | | IPD080Abv | (299) | ENKE | IPD080Aca | (299) | EKKE |
| IPD080Ada | (258) | | IPD080Aad | (299) | EKD- | IPD080Ah | (299) | EKKE |
| IPD080Adh | (260) | | IPD080Au | (299) | EKD- | IPD080Aag | (299) | EKKE |
| IPD080Acz | (256) | | IPD080Acb | (296) | EKD- | IPD080Ac | (299) | EKKE |
| IPD080Ade | (258) | | IPD080Acc | (296) | EKD- | IPD080Av | (299) | EKR- |
| IPD080Adc | (256) | | IPD080Bb | (297) | EKKE | IPD080Abk | (299) | EKKE |
| IPD080Adf | (256) | | IPD080Be | (297) | EKKE | IPD080Abl | (299) | EKKE |
| IPD080Adi | (256) | | IPD080Aav | (299) | EQKE | IPD080Aq | (299) | EKD- |
| IPD080Adj | (260) | | IPD080Aab | (299) | EKKE | IPD080Abr | (299) | EKKE |
| IPD080Adk | (256) | | IPD080Aal | (299) | EKKE | IPD080Abs | (299) | EKKE |
| IPD080Bf | (291) | | IPD080Aai | (299) | EKKE | IPD080Am | (299) | EKKE |
| IPD080Bg | (291) | | IPD080Aaj | (299) | EKKE | IPD080Aax | (299) | EKKE |
| IPD080Bi | (291) | | IPD080Aao | (299) | EKKE | IPD080Aay | (299) | EKKE |
| IPD080Bh | (291) | | IPD080Aar | (299) | EKKE | IPD080As | (299) | EKKE |
| IPD080Bj | (291) | | IPD080Abc | (299) | EKKE | IPD080Ag | (299) | EKKE |
| IPD080Bk | (297) | | IPD080Abd | (299) | EKKE | IPD080Abe | (299) | EKKE |
| IPD080Bn | (301) | | IPD080Acg | (299) | EKKE | IPD080Abf | (299) | EKKE |
| IPD080Bm | (295) | | IPD080Ab | (299) | EKKE | IPD080Abg | (299) | EKKE |
| IPD080Bl | (295) | | IPD080Aby | (299) | EKKE | IPD080Acl | (299) | EKKE |
| IPD080Bo | (295) | | IPD080Abz | (299) | EKKE | IPD080Acm | (299) | EKKE |
| IPD080Aah | (299) | EKKE | IPD080Aaq | (299) | EKKE | IPD080Ak | (299) | EKKE |
| IPD080Abp | (299) | EKKE | IPD080Aas | (299) | EKKE | IPD080Al | (299) | EKKE |
| IPD080Abq | (299) | EKKE | IPD080Ad | (299) | EKKE | IPD080Ap | (299) | EKKE |
| IPD080Abw | (299) | EKKE | IPD080Ba | (299) | EKKE | IPD080Aat | (299) | EKD- |
| IPD080Abx | (299) | EKKE | IPD080Bc | (299) | EKKE | IPD080Aau | (299) | EKDG |
| IPD080Abi | (299) | EKKE | IPD080Bd | (299) | EKKE | IPD080Aaw | (299) | EKKE |
| IPD080Ach | (299) | EKKE | IPD080Aci | (299) | EKD- | IPD080Aaz | (299) | EKKE |
| IPD080Ae | (299) | EKKE | IPD080Acj | (299) | EKD- | IPD080Ack | (299) | EKKE |
| IPD080At | (299) | EKKE | IPD080Aap | (299) | KKE- | IPD080Aj | (299) | EKKE |
| IPD080Acu | (299) | EKKE | IPD080Abm | (299) | EKKE | | | |
| IPD080Af | (299) | EKKE | IPD080Abn | (299) | EKKE | | | |
| IPD080Aaa | (299) | EKKE | IPD080Abo | (299) | EKKK | | | |
| IPD080Ar | (299) | EKKE | IPD080Ao | (299) | EKKE | | | |
| IPD080Ax | (299) | EKKE | IPD080Aac | (299) | EKD- | | | |
| *IPD080Abh* | *(299)* | *EKKE* | IPD080Aae | (299) | EKD- | | | |
| IPD080Acv | (299) | EKKE | IPD080Aw | (299) | EKD- | | | |
| IPD080Acx | (299) | EKKE | IPD080Az | (299) | EKD- | | | |
| IPD080Acw | (299) | DKKE | IPD080Acd | (299) | EKKE | | | |
| IPD080Acr | (299) | EKKE | IPD080Ace | (299) | EKKE | | | |

Fig. 2A

```
                    1                                                50
IPD080Ba    (1)  MAFVIDIEPGNVRVSGSSQHIITDADVRTFGLNDNALKNAVQAHFERRPN
IPD080Bc    (1)  MAFVINIEPGNVRVSGSSQHIITDADVRTFGLNDNALKNAVQAHFERRPN
IPD080Bd    (1)  MAFLIDIEPGNVRVSGSSQHIITDADVRTFGLNDNALKNAVQAHFERRPN
IPD080Bb    (1)  MSIQIDIEPGNVQVSGSSRHIITDADVRTFGLNDNALKNAVLAHFERRPN
IPD080Be    (1)  MSIQIDIEPGNVRVSGSSRHIITDADVRTFGLNDNALKNAVLAHFERRPN
IPD080Bk    (1)  MSIEIDIEPGSVRVSGSSRHIITDADVGTFGLHDNALKNAVLAHNGRRPN
IPD080Bn    (1)  MSIEIDIEPGSVRVSGSSRHIITDADVGTFGLHDNALKNAVLAHNGRRPN
IPD080Bm    (1)  MSIEIDIEPGSVRVSGSSRHIITDADVGTFGLHDNALKNAVLAHNGRRPN
IPD080Bl    (1)  MSIEIDIEPGSVRVSGSSRHIITDADVGTFGLHDDALKNAVLAHNGRRPN
IPD080Bo    (1)  MSIEIDIEPGSVRVSGSSRHIITDADVGTFGLHDNALKNAVLAHNGRRPN
IPD080Bh    (1)  MSIEIDIEPGRVRVSGSSRHIITDADVGTFGLHDNALKNAVLAHFGRRPN
IPD080Bj    (1)  MSIEIDIEPGRVRVSGSSRHIITDADVGTFGLHDNALKNAVLAHFGRRPN
IPD080Bf    (1)  MSIEIDIEPGRVRVSGSSRHIITDADVGTFGLHDNALKNAVLAHFGRRPN
IPD080Bg    (1)  MSIEIDIEPGRVWVSGSSRHIITDADVGTFGLHDNALKNAVLAHFGRRPN
IPD080Bi    (1)  MSIEIDIEPGRVRVSGSSRHIITDADVGTFGLHDNALKNAVLAHFGRRPN 51                                              100
IPD080Ba   (51)  DAFLRSPTPWGDLYTSYGWPQVQTVLAVRSSQILEETSRPVMLAYQTFVN
IPD080Bc   (51)  DAFLRSPTPWGDLYTSYGWPQVQTVLAVRSSQILEETSRPVMLAYQTFVN
IPD080Bd   (51)  DAFLRSPTPWGDLYTSYGWPQVQTVLAVRSSQILEETSRPVMLAYQTFVN
IPD080Bb   (51)  DAFLRSPTPWGDLYTTYGWPQVQTVLAVRSSQILEETSRPVMLDYQNFVN
IPD080Be   (51)  DAFLRSPMPWGDLYTTYGWPQVQTVLAVRSSQILEETSRPVMLDYQNFVN
IPD080Bk   (51)  DAFLRSPTPWNDLYTTYGWAQVQTVLVVRSSTILEESSRPTSLAYQNFVN
IPD080Bn   (51)  DAFLRSPTPWNDLYTTYGWAQVQTVLVVRSSTILEESSRPTSLAYQNFVN
IPD080Bm   (51)  DAFLRSPTPWNDLYTTYGWAQVQTVLVVRSSTILEESSRPTSLAYQNFVN
IPD080Bl   (51)  DAFLRSPTSWNDLYTTYGWAQVQTVLVVRSSTILEQSSRPTALAYQNFIN
IPD080Bo   (51)  DAFLRSPTPWNDLYTTYGWAQVQTVLVVRSSTILEQSSRPTALAYQNFIN
IPD080Bh   (51)  DAFLRSPTPWNDLYTSYGWAQVQTVLVVRSSTILEESSRPAMLAYQNFIN
IPD080Bj   (51)  DAFLRSPTPWNDLYTSYGWAQVQTVLVVRSSTILEESSRPAMLAYQNFIN
IPD080Bf   (51)  DAFLRSPTPWNDLYTSYGWAQVQTVLVVRSSTILEESSRPAMLAYQNFIN
IPD080Bg   (51)  DAFLRSPTPWNDLYTSYGWAQVQTVLVVRSSTILEESSRPAMLAYQNFIN
IPD080Bi   (51)  DAFLRSPTPWNDLYTSYGWAQVQTVLVVRSSTILEESSRPAMLAYQNFIN 101                                             150
IPD080Ba  (101)  NTNTEATYTANMSRVMRNSSSNAWSNTHSLSFQQKIKYGINFGITAQGET
IPD080Bc  (101)  NTNTEATYTANMSRVMRNSSSNAWSNTHSLSFQQKIKYGINFGITAQGET
IPD080Bd  (101)  NTNTEATYTANMSRVMRNSSSNAWSNTHSLSFQQKIKYGINFGITAQGET
IPD080Bb  (101)  NTNTEATYPANMSRAVTTSLSNTWSNTHSLAFEQKIKYGINFGITAQGGT
IPD080Be  (101)  NTNTEATYPANMSRAVTTSLSNTWSNTHSLAFEQKIKYGISFGITAQGGT
IPD080Bk  (101)  NTSSEATYTAHLSREMTNSSSNTWSNTHSIRFEQTITYKINFGITAGGET
IPD080Bn  (101)  NTSSEATYTAHLSREMTNSSSNTWSNTHSIRFEQTITYKINFGITAGGET
IPD080Bm  (101)  NTSSEATYTAHLSREMTNSSSNTWSNTHSIRFEQTITYKINFGITAGGET
IPD080Bl  (101)  NTSTEATYTAQLSREMTNSSSNTWSNTHSIRFEQTITYKINFGITAGGET
IPD080Bo  (101)  NTSTEATYTAQLSREMTNSSSNTWSNTHSIRFEQTITYKINFGITAGGET
IPD080Bh  (101)  NTSTEATYTAEMSRAMTNSSSNTWSNTHNIRFEQTITYKINFGITAGGET
IPD080Bj  (101)  NTSTEATYTAEMSRAMTNSSSNTWSNTHNIRFEQTITYKINFGITAGGET
IPD080Bf  (101)  NTSTEATYTAEMSRAMTNSSSNTWSNTHNIRFEQTITYKINFGITAGGET
IPD080Bg  (101)  NTSTEATYTAEMSRAMTNSSSNTWSNTHNIRFEQTITYKINFGITAGGET
IPD080Bi  (101)  NTSTEATYTAEMSRAMTNSSSNTWSNTHNIRFEQTITYKINFGITAGGET
```

Fig. 2B

```
             151                                                          200
IPD080Ba (151) TLSYQFSFGQSGTESVSTTISTGAGVSVVVAPHRTKHAILSASEGRMRVR
IPD080Bc (151) TLSYQFSFGQSGTESVSTTISTGAGVSVVVAPHRTKHAILSASEGRMRVR
IPD080Bd (151) TLSYQFSFGQSGTESVSTTISTGAGVSVVVAPHRTKHAILSASEGRMRVR
IPD080Bb (151) TLSYKFSFGQSWTESVSITIS--AVASVVVGPHQTKHAILSALEGRMRVR
IPD080Be (151) TLSYKFSFGQSWTESVSITIS--AVASVVVGPHQTKHAILSALEGQMRVR
IPD080Bk (151) SFGYESFGQSGTHETSTTISSGASVSVVVGPHRTKHAILSASEGRMRVR
IPD080Bn (151) SFGYESFGQSGTHETSTTISSGASVSVVVGPHRTKHAILSASEGRMRVR
IPD080Bm (151) SFGYESFGQSGTHETSTTISSGASVSVVVGPHRTKHAILSASEGRMRVR
IPD080Bl (151) SLGYESFGQSGTHETSTTISSGASVSVVVGPHRTKHAILSASEGRMRVR
IPD080Bo (151) SLGYESFGQSGTHETSTTISSGASVSVVVGPHRTKHAILSASEGRMRVR
IPD080Bh (151) SMGYEFSFGQSGTNETSTTISSGAAVSVVVGPHRTKHAILSASEGRMRVR
IPD080Bj (151) SMGYEFSFGQSGTNETSTTISSGAAVSVVVGPHRTKHAILSASEGRMRVR
IPD080Bf (151) SMGYEFSFGQSGTTETSTTISSGAAVSVVVGPHRTKHAILSASEGRMRVR
IPD080Bg (151) SMGYEFSFGQSGTTETSTTISSGAAVSVVVGPHRTKHAILSASEGRMRVR
IPD080Bi (151) SMGYEFSFGQSGTTETSTTISSGAAVSVVVGPHRTKHAILSASEGRMRVR 201                                                          250
IPD080Ba (201) IRYEAYLTGSTAVNYNPRHRGHHFWGLGIAGVMRSGNISNTRTITEDISL
IPD080Bc (201) IRYEAYLTGSTAVNYNPRHRGHHFWGLGIAGVMRSGNISNTRTITEDISL
IPD080Bd (201) IRYEAYLTGSTAVNYNPRHRGHHFWGLGIAGVMRSGNISNTRTITEDISL
IPD080Bb (199) IRYEAYLTGSTAVNYNPRHRGHHFWGLGIDGVMRSGNISNTRTITEDISL
IPD080Be (199) IRYEAYLTGSTAVNYNPRHRGHHFWGLGIDGVMRSGNISNTRTITEDISL
IPD080Bk (201) ITYEVYLTGSTAVNYNPRHNGHHFWGLGISGVMRSGNISNTRTITEDVTL
IPD080Bn (201) ITYEVYLTGSTAVNYNPRHNGHHFWGLGISGVMRSGNISNTRTITEDVTL
IPD080Bm (201) ITYEVYLTGSTAVNYNPRHNGHHFWGLGISGVMRSGNISNTRTITEDVTL
IPD080Bl (201) ITYEVYLTGSTAVNYNPRHNGHHFWGLGISGVMRSGNISNTRTITEDVTL
IPD080Bo (201) ITYEVYLTGSTAVNYNPRHNGHHFWGLGISGVMRSGNISNTRTITEDVTL
IPD080Bh (201) ITYEVYLTGSTAVNYNPRHNGHHFWGLGIAGVMRSGNISSTRTITEDITL
IPD080Bj (201) ITYEVYLTGSTAVNYNPRHNGHHFWGLGIAGVMRSGNISSTRTITEDITL
IPD080Bf (201) ITYEVYLTGSTAVNYNPRHNGHHFWGLGIAGVMRSGNISSTRTITEDITL
IPD080Bg (201) ITYEVYLTGSTAVNYNPRHNGHHFWGLGIAGVMRSGNISSTRTITEDITL
IPD080Bi (201) ITYEVYLTGSTAVNYNPRHNGHHFWGLGIAGVMRSGNISSTRTITEDITL 251                                                          300
IPD080Ba (251) QSYSNGRVLLEEGPAPISLVEEVTTLNEKATAPIPVIESTEPLEEEEEKKE
IPD080Bc (251) QSYSNGRVLLEEGPAPISLVEEVTTLNEKATAPIPVIESTEPLEEEEEKKE
IPD080Bd (251) QSYSNGRVLLEEGPAPISLVEEVTTLNEKATAPIPVIESTEPLEEEEEKKE
IPD080Bb (249) HSYSNGSVVFGEGPAPLSLVEEVKTLNEKATTPIPVIESTEPLEEEEEKKE
IPD080Be (249) HSYSNGSVVFGEGPAPLSLVEEVKTLNEKATTPIPVIESTEPLEEEEEKKE
IPD080Bk (251) QSYSNGSIVLGEGPAPSAVVEAVETLEKEQEKEKEKEK----KGS------
IPD080Bn (251) QSYSNGSIVLGEGPAPSAVVEAVETLEKEQEKEKEKEKEKKGS-------
IPD080Bm (251) QSYSNGSIVLGEGPAPSAVVEAVETLEKEQ--EKEKEK----KGS------
IPD080Bl (251) QSYSNGSIVLGEGPAPSPVVEAVETLEKEK--EKEKEK----KGS------
IPD080Bo (251) QSYSNGSIVLGEGPAPSAVVEAVETLEKEK--EREREK----KGS------
IPD080Bh (251) QSYSNGSIVLGEGPAPSPVVEEVEKLEKEK--------EK----KGS------
IPD080Bj (251) QSYSNGSIVLGEGPAPSPVVEEVEKLEKEK--------EK----KGS------
IPD080Bf (251) QSYSNGSIVLGEGPAPSPVVEEVETLEKEK--------EK----KGS------
IPD080Bg (251) QSYSNGSIVLGEGPAPSPVVEEVETLEKEK--------EK----KGS------
IPD080Bi (251) QSYSNGSIVLGEGPAPSPGVEEIETLEKEK--------EK----KGS------
```

Fig. 3A

```
                   1                                                  50
IPD080Da   (1)  MAFVVQVKHGRVNATGNSEHVITDADVRSFGIHDSALKDAVTKHFGRWPT
IPD080Db   (1)  MAFVVQVKNGRVNATGNSEHVITDADVRSFGIHDSALKDAVTKHFGRWPT
IPD080Dd   (1)  MAFVVQVKNGRVNATGNSEHVITDADVRSFGIHDSALKDAVTKHFGRWPT
IPD080Dg   (1)  MAFVVQVKNGRVNATGNSEHVITDADVKSFGIHDSALKDAVTKHFGRWPT
IPD080Dc   (1)  MAFVVQVKNGRVNATGNSEHVITDADVRSFGIHDSALKDAVTKHFGRWPT
IPD080De   (1)  MAFVVQVKNGRVNATGNSEHVITDADVKSFGIHDSALKDAVTKHFGRWPT
IPD080Dh   (1)  MAFVVQVKNGRVNATGNSEHVITDADVKSFGIHDSALKDAVTKHFGRWPT
IPD080Df   (1)  MAFVIAIKPGNVNATGNSQHVITDADVKSFGIHDSALKDAVTKHFGRWPT
IPD080Daa  (1)  MAFLIEVKPGKVNATGNFQHVITGADVKSFGIHDSALKEAVTKYFDRWPT
IPD080Dy   (1)  MAFLIEVKPGKVNATGNFQHVITDADVKSFGIHDSALKEAVTKYFDRWPT
IPD080Dz   (1)  MAFLIEVKPGKVNATGNFQHVITDADVKSFGIHDSALKEAVTKYFDRWPT
IPD080Dx   (1)  MAFVIKVKPGNVNATGNSQHVITDADVKSFGIHDSALKEAVTKYFDRWPT
IPD080Dw   (1)  MAFVIKVKPGNVNATGNSQHVITDADVKSFGIHDSALKDAVTKYFDRWPT
IPD080Dab  (1)  MAFVIDVEPESLNVTGYSEHVITDDDVDFFGVGDDALKNAVQSYFGRRPN
IPD080Dad  (1)  MAFVIDVEPESLNVTGYSEHVITDDDVDFFGVGDDALKNAVQSYFGRRPN
IPD080Dac  (1)  MAFVIDVEPESLNVTGYSEHVITDDDVNFFGVGDDALKNAVNSFFGQRPN
IPD080Dae  (1)  MAFVIDVEPESLNVTGYSEHVITDDDVNFFGVGDDALKNAVNSFFGQRPN
IPD080Di   (1)  MAFVIKVKPGKVNATGNSRHVITDADVNSFGIHDSALKDAVTKYFGRWPT
IPD080Dj   (1)  MAFVIKVKPGKVNASGNSQHVITDADVKSFGIHDSALKDAVTKYFGRWPT
IPD080Dk   (1)  MAFVIKVKPGNVNATGNSQHVITDADVKSFGIHDSALKDAVTKYFGRWPT
IPD080Dl   (1)  MAFVIKVKPGNVNATGNSQHVITDADVKSFGIHDSALKDAVTKYFGRWPT
IPD080Dm   (1)  MAFVIKVKPGNVNATGNSQHVITDADVKSFGIHDSALKDAVTKYFGRWPT
IPD080Ds   (1)  MAFVIKVKPGNVNATGNSQHVITDADVKSFGIHDSALKDAVTKYFGRWPT
IPD080Dt   (1)  MAFVIKVKPGNVNATGNSQHVITDADVKSFGIHDSALKDAVTKYFGRWPT
IPD080Du   (1)  MAFVIKVKPGNVNATGNSQHVITDADVKSFGIHDSALKDAVTKYFGRWPT
IPD080Dv   (1)  MAFVIKVKPGNVNATGNSQHVITDADVKSFGIHDSALKDAVTKYFGRWPT
IPD080Dn   (1)  MAFVIKVKPGNVNATGNSQHVITDADVKSFGIHDSALKGAVTKYFGRWPT
IPD080Do   (1)  MAFVIKVKPGNVNATGNSQHVITDADVKSFGIHDSALKDAVTKYFGRWPT
IPD080Dp   (1)  MAFVIKVKPGNVNATGNSQHVITDADVKSFGIHDSALKDAVTKYFGRWPT
IPD080Dq   (1)  MAFVIKVKPGNVNATGNSQHVITDADVKSFGIHDSALKDAVTKYFGRWPT
IPD080Dr   (1)  MAFVIKVKPGNVNATGNSQHVITDADVKSFGIHDSALKDAVTKYFGRWPT
```

Fig. 3B

```
                  51                                                100
IPD080Da   (51)   DAYLKSPTPWNDLYKTYGWPQVQTVLKVQSSSITEATSKPVIVAYQNFVN
IPD080Db   (51)   DAYLKSPTPWNDLYKTYGWPQVQTVLKVQSSSITEATSKPVIVAYQNFVN
IPD080Dd   (51)   DAYLKSPTPWNDLYKTYGWPQVQTVLKVQSSSITEATSKPVIVAYQNFVN
IPD080Dg   (51)   DAYLKSPTPWNDLYKTYGWPQVQTVLKVQSSSITEATSKPVIVAYQNFVN
IPD080Dc   (51)   DAYLKSPTPWNDLYKTYGWPQVQTVLNVQSSSITEATSKPVIVAYQNFVN
IPD080De   (51)   DAYLKSPTPWNDLYKTYGWPQVQTVLNVQSSSITEATSKPVIVAYQNFVN
IPD080Dh   (51)   DAYLKSPTPWNDLYKTYGWPQVQTVLNVQSSSITEATSKPVIVAYQNFVN
IPD080Df   (51)   DAYLKSPTPWNDLYKTYGWPQVQTVLNVQSSSITEATSKPVIVAYQNFVN
IPD080Daa  (51)   DAYLRSPTPWGDLYTKYGWPQVQTVLTVQSSTITEASSKPVILDYQNFVN
IPD080Dy   (51)   DAYLRSPTPCGDLYTKYGWPQVQTVLTVQSSTITEASSKPVILDYQNFVN
IPD080Dz   (51)   DAYLRSPTPWGDLYTKYGWPQVQTVLTVQSSTITEASSKPVILDYQNFVN
IPD080Dx   (51)   DAYLRSPTPWGDLYTKYGWPQVQTVLTVQSSTITEASSKPVILDYQNFVN
IPD080Dw   (51)   DAYLRSPTPWGDLYTKYGWPQVQTVLTVQSSTITEASSKPVILDYQNFVN
IPD080Dab  (51)   DAYLRSPTPWGDLYSTYGWPQVQTVLQVVSSTVTEESSNPVALAYQNFIN
IPD080Dad  (51)   DAYLRSPTPWGDLYSTYGWPQVQTVLQVVSSTVTEESSNPVALAYQNFIN
IPD080Dac  (51)   DAFLRSPTPWGDLYSTYGWPQVQTFLQVVSSTVTEESSNPVTLAYQNFIN
IPD080Dae  (51)   DAFLRSPTPWGDLYSTYGWPQVQTVLQVVSSTVTEESSNPVALAYQNFIN
IPD080Di   (51)   DAYLKSPTPWNDLYKTYGWPQVQTVLKVQSSSITEASSKLVILQYQNFVN
IPD080Dj   (51)   DAYLKSPTPWNDLYKTYGWPQVQTVLKVQSSSITEATSKPVILDYQNFVN
IPD080Dk   (51)   DAYLKSPTPWNDLYKTYGWPQVQIVLKVQSSSITEASSKPVILQYQNFIN
IPD080Dl   (51)   DAYLKSPTPWNDLYKTYGWPQVQIVLKVQSSSITEASSKPVILQYQNFIN
IPD080Dm   (51)   DAYLKSPTPWNDLYKTYGWPQVQIVLKVQSSSITEASSKPVILQYQNFIN
IPD080Ds   (51)   DAYLKSPTPWNDLYKTYGWPQVQIVLKVQSSSITEASSKPVILQYQNFIN
IPD080Dt   (51)   DAYLKSPTPWNDLYKTYGWPQVQIVLKVQSSSITEASSKPVILQYQNFIN
IPD080Du   (51)   DAYLKSPTPWNDLYKTYGWPQVQIVLKVQSSSITEASSKPVILQYQNFIN
IPD080Dv   (51)   DAYLKSPTPWNDLYKTYGWPQVQIVLKVQSSSITEASSKPVILQYQNFIN
IPD080Dn   (51)   DAYLKSPTPWNDLYRTYGWPQVQIVLKVQSSSITEASSKPVILQYQNFIN
IPD080Do   (51)   DAYLKSPTPWNDLYKTYGWPQVQIVLKVQGSSITEASSKPVILQYQNFIN
IPD080Dp   (51)   DAYLKSPTPWNDLYKTYGWPQVQIVLKVQSSSITEASSKPVILQYQNFIN
IPD080Dq   (51)   DAYLKSPTPWNDLYKTYGWPQVQIVLKVQSSSITEASSKPVILQYQNFIN
IPD080Dr   (51)   DAYLKSPTPWNDLYKTYGWPQVQIVLKVQSSSITEASSKPVILQYQNFIN
```

Fig. 3C

```
                    101                                                    150
IPD080Da   (101)  NSNEEATYTANMSRQKTNSASHTWSNQHTLKIEQKIKYEINFGVNVGGET
IPD080Db   (101)  NSNEEATYTANMSRQKTNSASHTWSNQHTLKIEQKIKYEINFGVNVGGES
IPD080Dd   (101)  NSNEEATYTANMSRQKTNSASHTWSNQHTLKIEQKIKYEINFGVNVGGES
IPD080Dg   (101)  NSNEEATYTANMSRQKTNSASHTWSNQHTLKIEQKIKYEINFGVNVGGES
IPD080Dc   (101)  NSNEESTYTANMSRQKTNSASHTWSNQHTLKIEQKIKYEINFGVNVGGET
IPD080De   (101)  NSNEESTYTANMSRQKTNSASHTWSNQHTLKIEQKIKYEINFGVNVGGET
IPD080Dh   (101)  NSNEESTYTANMSRQKTNSASHTWSNQHTLKIEQKIKYEINFGVNVGGES
IPD080Df   (101)  NSNEESTYTANMSRQKTDSASHTWSSQHTLKVDQKIKYEINFGVNVGGET
IPD080Daa  (101)  KSSKEATYTANMSRHETNSASNTWSHQHTFKIDQKITYKVDFGVNAGGET
IPD080Dy   (101)  KSSKEATYTANMSRHKTNSASNTWSNQHTFKIDQKITYKIDFGVNAGGET
IPD080Dz   (101)  KSSKEATYTANMSRHKTNSASNTWSNQHTFKIDQKITYKIDFGVNAGGET
IPD080Dx   (101)  KSSKEATYTANMSRHKTNSASNTWSNQHTFKIDQKITYKIDFGVNAGGET
IPD080Dw   (101)  KSSKEATYTANMSRHKTNSASNTWSNQHTFKIDQKITYKIDFGVNAGGET
IPD080Dab  (101)  DSSEEATYTASMSSQKTNSASNTWTSTNTIKVDQKIQYKINFGVEAGGET
IPD080Dad  (101)  DSSEEATYTASMSSQKANSASNTWTSTNTIKVDQKIQYKINFGVEAGGET
IPD080Dac  (101)  DSSEEATYTASMSSQKTNSASNTWTSTNTIKVDQKIQYKINFGVEAGGET
IPD080Dae  (101)  DSSEEATYTASMSSQKTNSASNNWTATNTIKVDQKIQYKINFGVEAGGET
IPD080Di   (101)  KSNEDATYTANMSRQKTNSASHTWSNQHTLKIEQKIKYEINFGVNVGGET
IPD080Dj   (101)  KSSEEATYTANMSRQKTNSASHTWSNQHTFKIDQKIKYEINFGANGGGET
IPD080Dk   (101)  KSNEEATYTANMSRQKTNSASHTWSNQHTLKVEQKIKYEINFGVNVGGET
IPD080Dl   (101)  KSNEEATYTANMSRQKTNSASHTWSNQHTLKVEQKIKYEINFGVNVGGET
IPD080Dm   (101)  KSNEEATYTANMSRQKTNSASHTWSNQHTLKVEQKIKYEINFGVNVGGET
IPD080Ds   (101)  KSNEEATYTANMSRQKNNSASHTWSNQHTLKVEQKIKYEINFGVNVGGET
IPD080Dt   (101)  KSNEEATYTANMSRQKNNSASHTWSNQHTLKVEQKIKCEINFGVNVGGET
IPD080Du   (101)  KSNEEATYTANMSRQKNNSASHTWSNQHTLKVEQKIKYEINFGVNVGGET
IPD080Dv   (101)  KSNEEATYTANMSRQKNNSASHTWSNQHTLKVEQKIKYEINFGVNVGGET
IPD080Dn   (101)  KSNEEATYTANMSRQKNNSASHTWSNQHTLKVEQKIKYEINFGVNVGGET
IPD080Do   (101)  KSNEEATYTANMSRQKNNSASHTWSNQHTLKVEQKIKYEINFGVNVGGET
IPD080Dp   (101)  KSNEEATYTANMSRQKNNSASHTWSNQHTLKVEQKIKYEINFGVNVGGET
IPD080Dq   (101)  KSNEEATYTANMSRQKTNSASHTWSNQHTLKVEQKIKYEINFGVNVGGET
IPD080Dr   (101)  KSNEEATYTANMSRQKTNSASHTWSNQHTLKVEQKIKYEINFGVNVGGET
```

Fig. 3D

```
                      151                                                  200
IPD080Da   (151)  TLSYQYAFGESGTKTVSTTISSGSAVTVKVGPHQTKHAILRASEGQMKVR
IPD080Db   (151)  TLSYQYAFGESGTKTVSTTISSGSAVTVKVGPHQTKHAILRASEGQMKVR
IPD080Dd   (151)  TLSYQYAFGESGTKTVSTTISSGSAVTVKAGPHQTKHAILRASEGQMKVR
IPD080Dg   (151)  TLSYQYAFGESGTKTVSTTISSGSAVTVKAGPHQTKHAILRASEGQMKVR
IPD080Dc   (151)  TLSYQYAFGESGTKTVSTTISSGSAVTVKVGPHQTKHAILRASEGQMKVR
IPD080De   (151)  TLSYQYAFGESGTKTVSTTISSGSAVTVKVGPHQTKHAILRASEGQMKVR
IPD080Dh   (151)  TLSYRYAFGESGTKTVSTTISSGSAVTVKVGPHQTKHAILRASEGQMKVR
IPD080Df   (151)  TLSYQYAFGESGTKTTTTTLSSGSGVKVNVGPHRTKHAILRASQGQMKVR
IPD080Daa  (151)  TLSYQYAFGESGTKTTTTTISSGSGVTVNVGPHQTKHAILRASEGQMKVR
IPD080Dy   (151)  TLSYQYAFGESGTKTTTTTISSGSGVTVNVGPHQTKHAILRASEGQMKVR
IPD080Dz   (151)  TLSYQYAFGESGTKTTTTTISSGSGVTVNVGPHQTKHAILRASEGQMKVR
IPD080Dx   (151)  TLSYQYAFGESGTKTTTTTISSGSGVTVNVGPHQTKHAILRASEGQMKVR
IPD080Dw   (151)  TLSYQYAFGESGTKTTTTTISSGSGVTVNVGPHQTKHAILRASEGQMKVR
IPD080Dab  (151)  DLSYQYAFGESGTKSTTFTISSGSSVTLQVDPHQTKHAILQASQGQKKIR
IPD080Dad  (151)  DLSYQYAFGESGTKSTTFTISSGSSVTLQVDPHQTKHAILQASQGQKKIR
IPD080Dac  (151)  DLSYQYAFGESGTQSTTFTISSGSSVTVQVDPHQTKHAILKASQGQKVR
IPD080Dae  (151)  DLSYQYAFGESGTQSTTFTISSGSSVTVQVDPHQTKHAILKASQGQKVR
IPD080Di   (151)  TLSYQYAFGESGTKTTTTTLSSGSGVTVKVGPHKTKHAILRASEGQMKVR
IPD080Dj   (151)  TLSYQYAFGESETKTTTTTLSSGSGVTVKVGPHKTKHAILRASEGQMKVR
IPD080Dk   (151)  TLSYQYAFGESGTKTTTTTLSSGSGVTVKVGPHKTKHAILRASEGQMKVR
IPD080Dl   (151)  TLSYQYAFGESGRKTTTTTLSSGSGVTAKVGPHKTKHAILRASEGQMKVR
IPD080Dm   (151)  TLSYQYAFGESGRKTTTTTLSSGSGVTVKVGPHKTKHAILRASEGQMKVR
IPD080Ds   (151)  TLSYQYAFGESGRKTTTTTLSSGSGVTVKVGPHKTKHAILRASEGQMKVR
IPD080Dt   (151)  TLSYQYAFGESGRKTTTTTLSSGSGVTVKVGPHKTKHAILRASEGQMKVR
IPD080Du   (151)  TLSYQYAFGESGRKTTTTTLSSGSGVTVKVGPHKTKHAILRASEGQMKVR
IPD080Dv   (151)  TLSYQYAFGESGRKTTTTTLSSGSATVKVGPHKTKHAILRASEGQMKVR
IPD080Dn   (151)  TLSYQYAFGESGTKTTTTTLSSGSGVTVKVGPHKTKHAILRASEGQMKVR
IPD080Do   (151)  TLSYQYAFGESGTKTTTTTLSSGSGVTVKVGPHKTKHAILRASEGQMKVR
IPD080Dp   (151)  TLSYQYAFGESGTKTTTTTLSSGSGVTVKVGPHKTKHAILRASEGQMKVR
IPD080Dq   (151)  TLSYQYAFGESGTKTTTTTLSSGSGVTVKVGPHKTKHAILRASEGQMKVR
IPD080Dr   (151)  TLSYQYAFGESGTKTTTTALSSGSGVTVKVGPHKTKHAILRASEGQMKVR
```

Fig. 3E

```
                    201                                                  250
IPD080Da   (201)  IVYEAHLKGSTAVNYNPTYKGHHFYGLDIAAVMSAGGISSRKTITEDVVL
IPD080Db   (201)  IVYEAHLKGSTAVNYNPTYKGHHFYGLDIAAVMSAGGISSRKTITEDVVL
IPD080Dd   (201)  IVYEAHLKGSTAVNYNPTYKGHHFYGLDIAAVMSAGGISSRKTITEDVVL
IPD080Dg   (201)  IVYEAHLKGSTAVNYNPTYKGHHFYGLDIAAVMSAGGISSRKTITEDVVL
IPD080Dc   (201)  IVYEAHLKGSTAVNYNPTYKGHHFYGLDIAAVMSAGGISSRKTITEDVVL
IPD080De   (201)  IVYEAHLKGSTAVNYNPTYKGHHFYGLDIAAVMSAGGISSRKTITEDVVL
IPD080Dh   (201)  IVYEAHLKGSTAVNYNPTYKGHHFYGLDIAAVMSAGGISSRKTITEDVVL
IPD080Df   (201)  IVYVAHLTGSIAVNYDPTYKGHHFYSLDIGVVMSKGGISSSKTITEDIVL
IPD080Daa  (201)  IVYVAHLTGSTAVNYYPTCKGHHFYSLDIAAVMSKGGISSSKTITEDILL
IPD080Dy   (201)  IVYVAHLTGSTAVNYYPTYKGHHFYSLDIAAVMSKGGISSSKTITEDILL
IPD080Dz   (201)  IVYVAHLTGSTAVNYYPTYKGHHFYSLDIAAVMSKGGISSSKTITEDILL
IPD080Dx   (201)  IVYVAHLTGSTAVNYYPTYKGHHFYSLDIAAVMSKGGISSSKTITEDILL
IPD080Dw   (201)  IVYVAHLTGSTAVNYYPTYKGHHFYSLDIAAVMSKGGISSSKTITEDILL
IPD080Dab  (201)  NTYVAYLIGSTAVNYNPTYKGHHFWDMDIAEVMSSGGISNSKIMTEDISL
IPD080Dad  (201)  NTYLASLIGSTAVNYDPTYKGHHFWDMDIGAVMSSGGISNSKIMTEDISL
IPD080Dac  (201)  ITYLASLIGSTAVNYDPTYKGHHFWDMDIGAVMSSGGISNSKIMTEDISL
IPD080Dae  (201)  ITYLASLIGSTAVNYDPTYKGHHFWDMDIGAVMSSGGISNSKIMTEDISL
IPD080Di   (201)  IVYVANLTGSTAVNYPTYKGHHFYSLDIAGVMSAGGICSSKTITEDVVL
IPD080Dj   (201)  IVYAAHLTGSTAVNYYPTYKGHHFYSLDIAGVMSAGGICSSKTITEDVVL
IPD080Dk   (201)  IVYVAHLTGSTAVNYYPTYKGHHFYSLDIAGVMSAGGISSSKTITEDVVL
IPD080Dl   (201)  IVYVAHLTGSTAVNYYPTYKGHHFYSLDIAGVMSAGGISSSKTITEDVVL
IPD080Dm   (201)  IVYVAHLTGSTAVNYYPTYKGHHFYSLDIAGVMSAGGISSSKTITEDVVL
IPD080Ds   (201)  IVYVAHLTGSTAVNYYPTYKGHHFYSLYIAGVMSAGGISSSKTITEDVVL
IPD080Dt   (201)  TVYVAHLTGSTAVNYYPTYKGHHFYSLDIAGVMSAGGISSSKTITEDVVL
IPD080Du   (201)  IVYVAHLTGSTAVNYYPTYKGHHFYSLDIAGVMSAGGISSSKTITEDVVL
IPD080Dv   (201)  IVYVAHLTGSTAVNYYPTYKGHHFYSLDIAGVMSAGGISSSKTITEDVVL
IPD080Dn   (201)  IVYVAHLTGSTAVNYYPTYKGHHFYSLDIAGVMSAGGISSSKTITEDVVL
IPD080Do   (201)  IVYVAHLTGSTAVNYYPTYKGHHFYSLDIAGVMSAGGISSSKTITEDVVL
IPD080Dp   (201)  IVYVAHLTGSTAVNYYPTYKGHHFYSLDIAGVMSAGGISSSKTITEDVVL
IPD080Dq   (201)  IVYVAHLTGSTAVNYYPTYKGHHFYSLDIAGVMSAGGISSSKTITEDVVL
IPD080Dr   (201)  IVYVAHLTGSTAVNYYPTYKGHHFYSLDIAGVMSAGGISSSKTITEDVVL
```

Fig. 3F

```
                      251                                        289
IPD080Da   (251) DYFAQSSVVVGDGPAPSSVLAAVAK
IPD080Db   (251) DYFAQSSVVVGDGPAPSSVLAAVAK
IPD080Dd   (251) DYFAQSSVVVGDGPAPSSVLAAVAK
IPD080Dg   (251) DYFAQSSVVVGDGPAPSSVLAAVAK
IPD080Dc   (251) DYFAQSSVVVGDGPAPSSVLAAVAK
IPD080De   (251) DYFAQSSVVVGDGPAPSSVLAAVAK
IPD080Dh   (251) DYFAQSSVVVGDGPAPSSVLAAVAK
IPD080Df   (251) DYYSHSTVEVGDGPAPSSVVLAVAK
IPD080Daa  (251) DYYSHSSVEVGDGPAPSSVSAAVAKGS
IPD080Dy   (251) DYYSHSSVEVGDGPAPSSVSAAVAKGS
IPD080Dz   (251) DYYSHSSVEVGDGPAPSSVSAAVAKGS
IPD080Dx   (251) DYYSHSSVEVGDGPAPSSVSAAVAKGS
IPD080Dw   (251) DYYSHSSVEVGDGPAPSSVSAAVAKGS
IPD080Dab  (251) DFYSNSSVEVGDGPAPTSVTLSIAEGS
IPD080Dad  (251) DFYSNSSVEVGDGPAPTSVTLSIAEGS
IPD080Dac  (251) DFFSNSSVEVGDGPAPTSVTLSIAEGS
IPD080Dae  (251) DFYSNSSVEVGDGPAPTSVTLSIAEGS
IPD080Di   (251) DYYSHSTVEVGDGPAPSSVLAAVAE
IPD080Dj   (251) DYYSHSTVEVGDGPAPSSVLAAVAE
IPD080Dk   (251) DYYSHSTVEVGDGPAPSSVSAAVAKGS
IPD080Dl   (251) DYYSHSTVEVGDGPAPSSVSAAVAKGS
IPD080Dm   (251) DYYSHSTVEVGDGPAPSSVSAAVAKGS
IPD080Ds   (251) DYYSHSTVEVGDGPAPSSVSAAVAKGS
IPD080Dt   (251) DYYSHSTVEVGDGPAPSSVSAAVAKGS
IPD080Du   (251) DYYSHSTVEVGDGPAPLSVSAAVAKGS
IPD080Dv   (251) DYYSHSTVEVGDGPAPLSVSAAVAKGS
IPD080Dn   (251) DYYSHSTVEVGDGPAPSSVSAAVAKGS
IPD080Do   (251) DYYSHSTVEVGDGPAPSSVSAAVAKGS
IPD080Dp   (251) DYYSHSTVEVGDGPAPSSVSAAVAKGS
IPD080Dq   (251) DYYSHSTVEVGDGPAPLSVSAAVAKGS
IPD080Dr   (251) DYYSHSTVEVGDGPAPLSVSAAVAKGS
```

Fig. 7

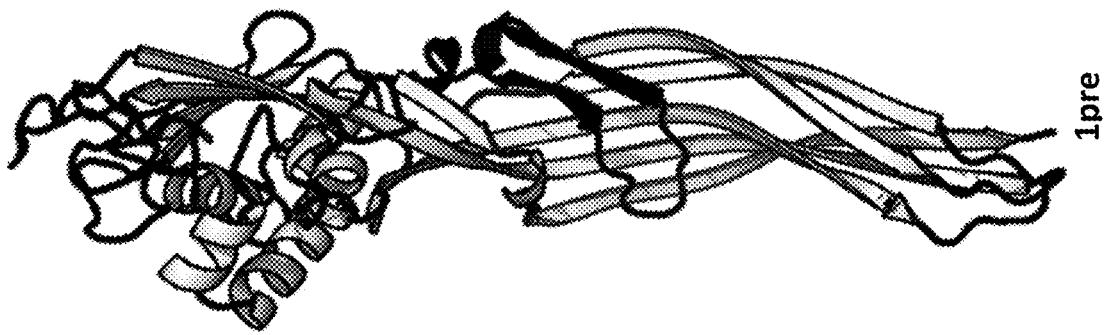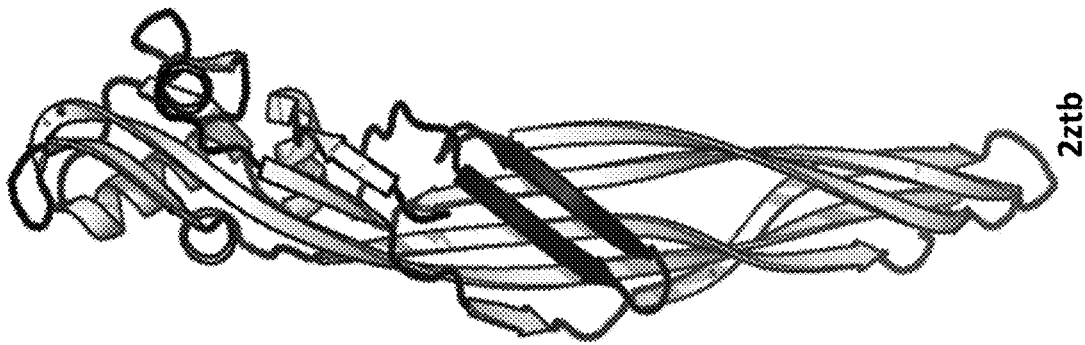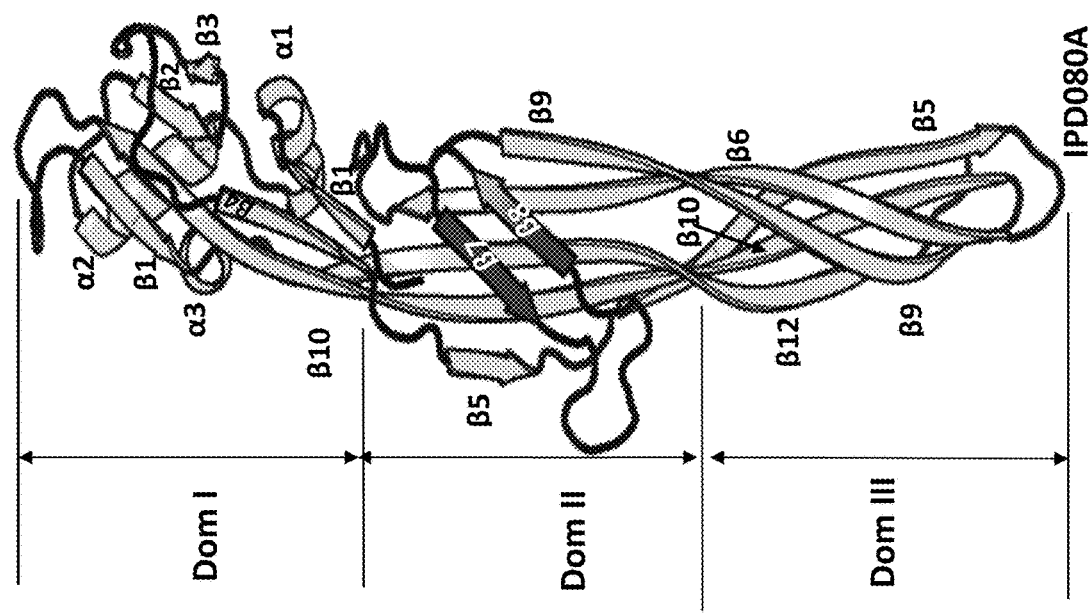

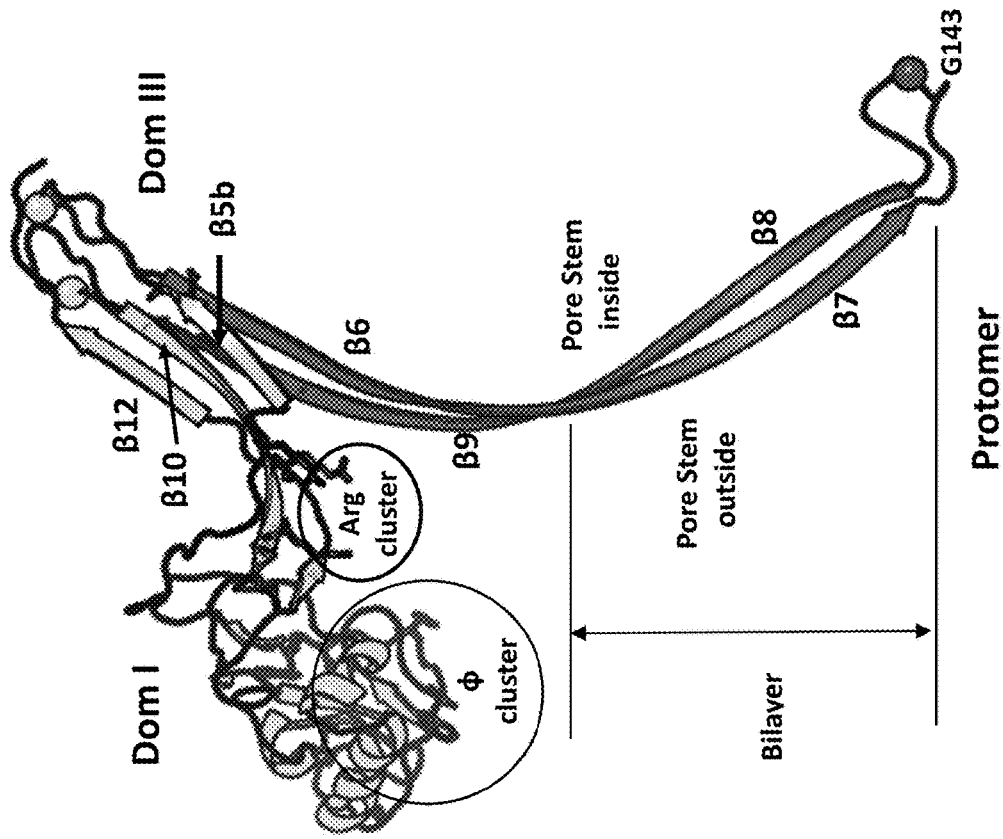
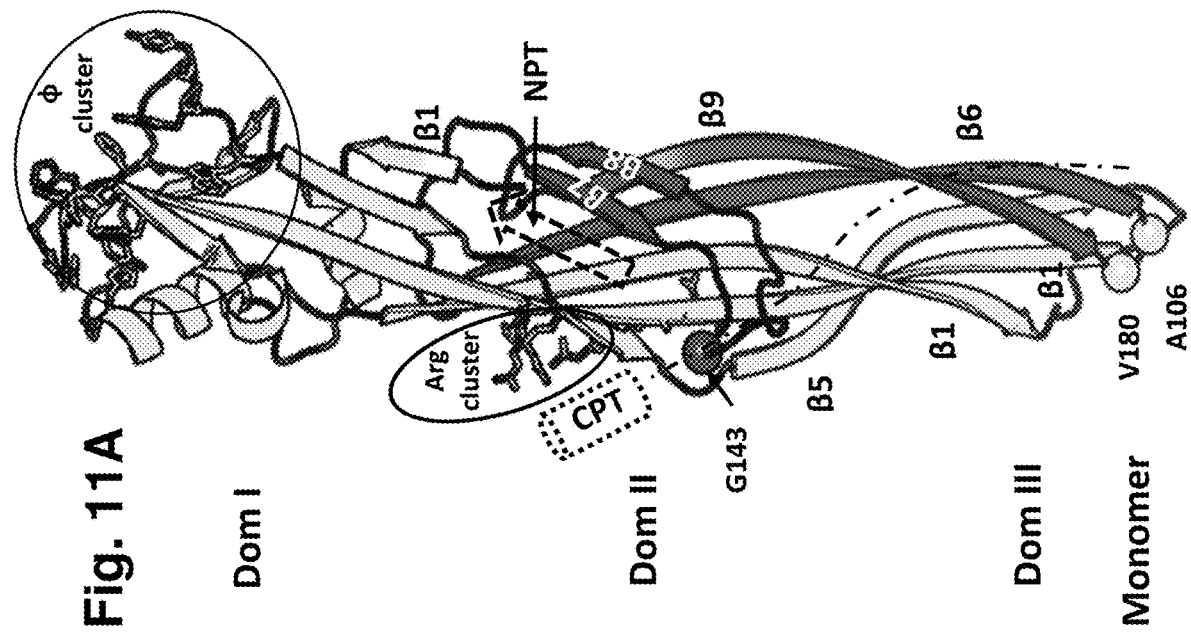

INSECTICIDAL PROTEINS FROM PLANTS AND METHODS FOR THEIR USE

CROSS-REFERENCE TO RELATED APPLICATIONS

This Application claims the benefit of U.S. Provisional Application No. 62/411,318 filed on Oct. 21, 2012, which is incorporated herein by reference in its entirety.

REFERENCE TO SEQUENCE LISTING SUBMITTED ELECTRONICALLY

The official copy of the sequence listing is submitted electronically via EFS-Web as an ASCII formatted sequence listing with a file named "6473WOPCT_SequenceListing" created on Oct. 2, 2017, and having a size of 663 kilobytes and is filed concurrently with the specification. The sequence listing contained in this ASCII formatted document is part of the specification and is herein incorporated by reference in its entirety.

FIELD

This disclosure relates to the field of molecular biology. Provided are novel genes that encode pesticidal proteins. These pesticidal proteins and the nucleic acid sequences that encode them are useful in preparing pesticidal formulations and in the production of transgenic pest-resistant plants.

BACKGROUND

Biological control of insect pests of agricultural significance using a microbial agent, such as fungi, bacteria or another species of insect affords an environmentally friendly and a commercially attractive alternative to synthetic chemical pesticides. Generally speaking, the use of biopesticides presents a lower risk of pollution and environmental hazards and biopesticides provide greater target specificity than is characteristic of traditional broad-spectrum chemical insecticides. In addition, biopesticides often cost less to produce and thus improve economic yield for a wide variety of crops.

Certain species of microorganisms of the genus *Bacillus* are known to possess pesticidal activity against a range of insect pests including Lepidoptera, Diptera, Coleoptera, Hemiptera and others. *Bacillus thuringiensis* (Bt) and *Bacillus popilliae* are among the most successful biocontrol agents discovered to date. Insect pathogenicity has also been attributed to strains of *B. larvae, B. lentimorbus, B. sphaericus* and *B. cereus*. Microbial insecticides, particularly those obtained from *Bacillus* strains, have played an important role in agriculture as alternatives to chemical pest control.

Crop plants have been developed with enhanced insect resistance by genetically engineering crop plants to produce pesticidal proteins from *Bacillus*. For example, corn and cotton plants have been genetically engineered to produce pesticidal proteins isolated from strains of *Bacillus thuringiensis*. These genetically engineered crops are now widely used in agriculture and have provided the farmer with an environmentally friendly alternative to traditional insect-control methods. While they have proven to be very successful commercially, these genetically engineered, insect-resistant crop plants provide resistance to only a narrow range of the economically important insect pests. In some cases, insects can develop resistance to different insecticidal compounds, which raises the need to identify alternative biological control agents for pest control.

Accordingly, there remains a need for new pesticidal proteins with different ranges of insecticidal activity against insect pests, e.g., insecticidal proteins which are active against a variety of insects in the order Lepidoptera and the order Coleoptera including but not limited to insect pests that have developed resistance to existing insecticides.

SUMMARY

In one aspect compositions and methods for conferring pesticidal activity to bacteria, plants, plant cells, tissues and seeds are provided. Compositions include nucleic acid molecules encoding sequences for pesticidal and insecticidal polypeptides, vectors comprising those nucleic acid molecules, and host cells comprising the vectors. Compositions also include the pesticidal polypeptide sequences and antibodies to those polypeptides. Compositions also comprise transformed bacteria, plants, plant cells, tissues and seeds.

In another aspect isolated or recombinant nucleic acid molecules are provided encoding IPD080 polypeptides including amino acid substitutions, deletions, insertions, and fragments thereof. Provided are isolated or recombinant nucleic acid molecules capable of encoding IPD080 polypeptides of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO:

295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344 or SEQ ID NO: 345, as well as amino acid substitutions, deletions, insertions, fragments thereof, and combinations thereof. Nucleic acid sequences that are complementary to a nucleic acid sequence of the embodiments or that hybridize to a sequence of the embodiments are also encompassed. The nucleic acid sequences can be used in DNA constructs or expression cassettes for transformation and expression in organisms, including microorganisms and plants. The nucleotide or amino acid sequences may be synthetic sequences that have been designed for expression in an organism including, but not limited to, a microorganism or a plant.

In another aspect IPD080 polypeptides are encompassed. Also provided are isolated or recombinant IPD080 polypeptides of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, and SEQ ID NO: 345, as well as amino acid substitutions, deletions, insertions, fragments thereof and combinations thereof.

In another aspect methods are provided for producing the polypeptides and for using those polypeptides for controlling or killing a Lepidopteran, Coleopteran, nematode, fungi, and/or Dipteran pests. The transgenic plants of the embodiments express one or more of the pesticidal sequences disclosed herein. In various embodiments, the transgenic plant further comprises one or more additional genes for insect resistance, for example, one or more additional genes for controlling Coleopteran, Lepidopteran, Hemipteran or nematode pests. It will be understood by one of skill in the art that the transgenic plant may comprise any gene imparting an agronomic trait of interest.

In another aspect methods for detecting the nucleic acids and polypeptides of the embodiments in a sample are also included. A kit for detecting the presence of an IPD080 polypeptide or detecting the presence of a polynucleotide encoding an IPD080 polypeptide in a sample is provided. The kit may be provided along with all reagents and control samples necessary for carrying out a method for detecting the intended agent, as well as instructions for use.

In another aspect, the compositions and methods of the embodiments are useful for the production of organisms with enhanced pest resistance or tolerance. These organisms and compositions comprising the organisms are desirable for agricultural purposes. The compositions of the embodiments are also useful for generating altered or improved proteins that have pesticidal activity or for detecting the presence of IPD080 polypeptides.

In another aspect, a monomer and a heptamer pore models of IPD080 polypeptides are provided. In another aspect, methods of identifying regions of an IPD080 polypeptide through rational protein design with a secondary, tertiary or quaternary structure of the IPD080 polypeptide to modified physical properties of the IPD080 polypeptide are provided. Methods of engineering a IPD080 polypeptide to have a modified physical property by employing rational protein design with a secondary, tertiary or quaternary structure of the IPD080 polypeptide are provided. Methods are provided to identify regions of IPD080 polypeptides, including but not limited to beta sheets, alpha helicies and loops between structural elements, which are involved in insect specificity. Methods are provided to identify regions of IPD080 polypeptides, including but not limited to a hydrophobic interface surface, which is involved in pore formation.

BRIEF DESCRIPTION OF THE FIGURES

FIG. 1A-1Q shows an amino acid sequence alignment, using the ALIGNX® module of the Vector NTI® suite, of the IPD080 homologs: IPD080Aa (SEQ ID NO: 160); IPD080Ab (SEQ ID NO: 161); IPD080Ac (SEQ ID NO: 162); IPD080Ad (SEQ ID NO: 163); IPD080Ae (SEQ ID NO: 164); IPD080Af (SEQ ID NO: 165); IPD080Ag (SEQ ID NO: 166); IPD080Ah (SEQ ID NO: 167); IPD080Ai (SEQ ID NO: 168); IPD080Aj (SEQ ID NO: 169); IPD080Ak (SEQ ID NO: 170); IPD080Al (SEQ ID NO: 171); IPD080Am (SEQ ID NO: 172); IPD080An (SEQ ID NO: 173); IPD080Ao (SEQ ID NO: 174); IPD080Ap (SEQ ID NO: 175); IPD080Aq (SEQ ID NO: 176); IPD080Ar (SEQ ID NO: 177); IPD080As (SEQ ID NO: 178); IPD080At (SEQ ID NO: 179); IPD080Au (SEQ ID NO: 180); IPD080Av (SEQ ID NO: 181); IPD080Aw (SEQ ID NO: 182); IPD080Ax (SEQ ID NO: 183); IPD080Ay (SEQ ID NO: 184); IPD080Az (SEQ ID NO: 185); IPD080Aaa (SEQ ID NO: 186); IPD080Aab (SEQ ID NO: 187); IPD080Aac (SEQ ID NO: 188); IPD080Aad (SEQ ID NO: 189); IPD080Aae (SEQ ID NO: 190); IPD080Aaf (SEQ ID NO: 191); IPD080Aag (SEQ ID NO: 192); IPD080Aah (SEQ ID NO: 193); IPD080Aai (SEQ ID NO: 194); IPD080Aaj (SEQ ID NO: 195); IPD080Aak (SEQ ID NO: 196); IPD080Aal (SEQ ID NO: 197); IPD080Aam (SEQ ID NO: 198); IPD080Aan (SEQ ID NO: 199); IPD080Aao (SEQ ID NO: 200); IPD080Aap (SEQ ID NO: 201); IPD080Aaq (SEQ ID NO: 202); IPD080Aar (SEQ ID NO: 203); IPD080Aas (SEQ ID NO: 204); IPD080Aat (SEQ ID NO: 205); IPD080Aau (SEQ ID NO: 206); IPD080Aav (SEQ ID NO: 207); IPD080Aaw (SEQ ID NO: 208); IPD080Aax (SEQ ID NO: 209); IPD080Aay (SEQ ID NO: 210); IPD080Aaz (SEQ ID NO: 211); IPD080Aba (SEQ ID NO: 212); IPD080Abc (SEQ ID NO: 213); IPD080Abd (SEQ ID NO: 214); IPD080Abe (SEQ ID NO: 215); IPD080Abf (SEQ ID NO: 216); IPD080Abg (SEQ ID NO: 217); IPD080Abh (SEQ ID NO: 218); IPD080Abi (SEQ ID NO: 219); IPD080Abj (SEQ ID NO: 220); IPD080Abk (SEQ ID NO: 221); IPD080Abl (SEQ ID NO: 222); IPD080Abm (SEQ ID NO: 223); IPD080Abn (SEQ ID NO: 224); IPD080Abo (SEQ ID NO: 225); IPD080Abp (SEQ ID NO: 226); IPD080Abq (SEQ ID NO: 227); IPD080Abr (SEQ ID NO: 228); IPD080Abs (SEQ ID NO: 229); IPD080Abt (SEQ ID NO: 230); IPD080Abu (SEQ ID NO: 231); IPD080Abv (SEQ ID NO: 232); IPD080Abw (SEQ ID NO: 233); IPD080Abx (SEQ ID NO: 234); IPD080Aby (SEQ ID NO: 235); IPD080Abz (SEQ ID NO: 236); IPD080Aca (SEQ ID NO: 237); IPD080Acb (SEQ ID NO: 238); IPD080Acc (SEQ ID NO: 239); IPD080Acd (SEQ ID NO: 240); IPD080Ace (SEQ ID NO: 241); IPD080Acf (SEQ ID NO: 242); IPD080Acg (SEQ ID NO: 243); IPD080Ach (SEQ ID NO: 244); IPD080Aci (SEQ ID NO: 245); IPD080Acj (SEQ ID NO: 246); IPD080Ack (SEQ ID NO: 247); IPD080AcI (SEQ ID NO: 248); IPD080Acm (SEQ ID NO: 249); IPD080Acn (SEQ ID NO: 250); IPD080Aco (SEQ ID NO: 251); IPD080Acp (SEQ ID NO: 252); IPD080Acq (SEQ ID NO: 253); IPD080Acr (SEQ ID NO: 254); IPD080Acs (SEQ ID NO: 255); IPD080Act (SEQ ID NO: 256); IPD080Acu (SEQ ID NO: 257); IPD080Acv (SEQ ID NO: 258); IPD080Acw (SEQ ID NO: 259); IPD080Acx (SEQ ID NO: 260); IPD080Acy (SEQ ID NO: 261); IPD080Acz (SEQ ID NO: 262); IPD080Ada (SEQ ID NO: 263); IPD080Adb (SEQ ID NO: 264); IPD080Adc (SEQ ID NO: 265); IPD080Ade (SEQ ID NO: 266); IPD080Adf (SEQ ID NO: 267); IPD080Adg (SEQ ID NO: 268); IPD080Adh (SEQ ID NO: 269); IPD080Adi (SEQ ID NO: 270); IPD080Adj (SEQ ID NO: 271); IPD080Adk (SEQ ID NO: 272); IPD080Ba (SEQ ID NO: 273); IPD080Bb (SEQ ID NO: 274); IPD080Bc (SEQ ID NO: 275); IPD080Bd (SEQ ID NO: 276); IPD080Be (SEQ ID NO: 277); IPD080Bf (SEQ ID NO: 278); IPD080Bg (SEQ ID NO: 279); IPD080Bh (SEQ ID NO: 280); IPD080Bi (SEQ ID NO: 281); IPD080Bj (SEQ ID NO: 282); IPD080Bk (SEQ ID NO: 283); IPD080Bl (SEQ ID NO: 284); IPD080Bm (SEQ ID NO: 285); IPD080Bn (SEQ ID NO: 286); and IPD080Bo (SEQ ID NO: 287). The amino acid sequence diversity between the sequences is highlighted.

FIG. 2A-2B shows an amino acid sequence alignment, using the ALIGNX® module of the Vector NTI® suite, of the IPD080 homologs: IPD080Ba (SEQ ID NO: 273); IPD080Bb (SEQ ID NO: 274); IPD080Bc (SEQ ID NO: 275); IPD080Bd (SEQ ID NO: 276); IPD080Be (SEQ ID NO: 277); IPD080Bf (SEQ ID NO: 278); IPD080Bg (SEQ ID NO: 279); IPD080Bh (SEQ ID NO: 280); IPD080Bi (SEQ ID NO: 281); IPD080Bj (SEQ ID NO: 282); IPD080Bk (SEQ ID NO: 283); IPD080Bl (SEQ ID NO: 284); IPD080Bm (SEQ ID NO: 285); IPD080Bn (SEQ ID NO: 286); and IPD080Bo (SEQ ID NO: 287). The amino acid sequence diversity between the sequences is highlighted.

FIG. 3A-3F shows an amino acid sequence alignment, using the ALIGNX® module of the Vector NTI® suite, of the IPD080 homologs: IPD080 Da (SEQ ID NO: 288); IPD080Db (SEQ ID NO: 289); IPD080Dc (SEQ ID NO: 290); IPD080Dd (SEQ ID NO: 291); IPD080De (SEQ ID NO: 292); IPD080Df (SEQ ID NO: 293); IPD080Dg (SEQ ID NO: 294); IPD080Dh (SEQ ID NO: 295); IPD080Di (SEQ ID NO: 296); IPD080Dj (SEQ ID NO: 297); IPD080Dk (SEQ ID NO: 298); IPD080Dl (SEQ ID NO: 299); IPD080Dm (SEQ ID NO: 300); IPD080Dn (SEQ ID NO: 301); IPD080Do (SEQ ID NO: 302); IPD080Dp (SEQ ID NO: 303); IPD080Dq (SEQ ID NO: 304); IPD080Dr (SEQ ID NO: 305); IPD080Ds (SEQ ID NO: 306); IPD080Dt (SEQ ID NO: 307); IPD080Du (SEQ ID NO: 308); IPD080Dv (SEQ ID NO: 309); IPD080Dw (SEQ ID NO: 310); IPD080Dx (SEQ ID NO: 311); IPD080Dy (SEQ ID NO: 312); IPD080Dz (SEQ ID NO: 313); IPD080Daa (SEQ ID NO: 314); IPD080Dab (SEQ ID NO: 315); IPD080Dac (SEQ ID NO: 316); IPD080Dad (SEQ ID NO: 317); and IPD080Dae (SEQ ID NO: 318). The amino acid sequence diversity between the sequences is highlighted.

Figure 4:
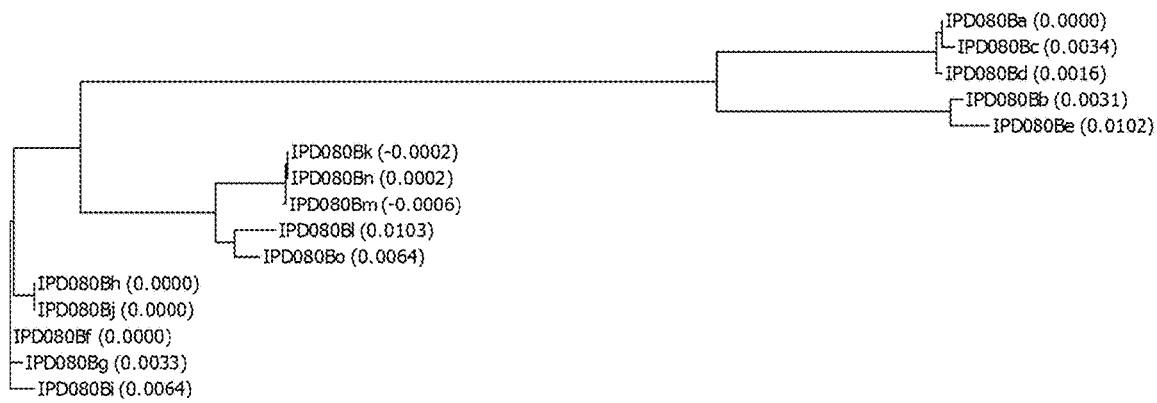
FIG. 4 shows a Phylogentic Tree, using the Neighbor Joining Method in the ALIGNX® module of the Vector NTI® suite, of the IPD080 homologs: IPD080Ba (SEQ ID NO: 273); IPD080Bb (SEQ ID NO: 274); IPD080Bc (SEQ ID NO: 275); IPD080Bd (SEQ ID NO: 276); IPD080Be (SEQ ID NO: 277); IPD080Bf (SEQ ID NO: 278); IPD080Bg (SEQ ID NO: 279); IPD080Bh (SEQ ID NO: 280); IPD080Bi (SEQ ID NO: 281); IPD080Bj (SEQ ID NO: 282); IPD080Bk (SEQ ID NO: 283); IPD080Bl (SEQ ID NO: 284); IPD080Bm (SEQ ID NO: 285); IPD080Bn (SEQ ID NO: 286); and IPD080Bo (SEQ ID NO: 287). The number in parentheses is the distant value.

In some embodiments, the IPD080 polypeptide includes an amino acid sequence deduced from the full-length nucleic acid sequence disclosed herein and amino acid sequences that are shorter than the full-length sequences, either due to the use of an alternate downstream start site or due to processing that produces a shorter protein having pesticidal activity. Processing may occur in the organism the protein is expressed in or in the pest after ingestion of the protein.

Thus, provided herein are novel isolated or recombinant nucleic acid sequences that confer pesticidal activity. Also provided are the amino acid sequences of IPD080 polypeptides. The protein resulting from translation of these IPD080 genes allows cells to control or kill certain pests that ingest it.

IPD080 Proteins and Variants and Fragments Thereof

IPD080 polypeptides are encompassed by the disclosure. "IPD080 polypeptide" and "IPD080 protein" as used herein interchangeably refers to a polypeptide having insecticidal activity including but not limited to insecticidal activity against one or more insect pests of the Lepidoptera and/or Coleoptera orders, and is sufficiently homologous to the IPD080Aa polypeptide of SEQ ID NO: 160. A variety of IPD080 polypeptides are contemplated. Sources of IPD080 polypeptides or related proteins include fern or other primitive plant species selected from but not limited to *Lycopodium* species, *Huperzia* species or a *Phlegmariurus* species.

In some embodiments, the IPD080 polypeptide is derived from a species in the Class Lycopodiopsida, Order Lycopodiales. In some embodiments, the IPD080 polypeptide is derived from a fern species in the Class Lycopodiopsida, Order Lycopodiales Family, Lycopodiaceae or Family Huperziaceae.

In some embodiments, the IPD080 polypeptide is derived from a species in the Genus *Lycopodium*. In some embodiments the IPD080 polypeptide is derived from a *Lycopodium* species selected from but not limited to *Lycopodium alpinum* L., *Lycopodium annotinum* L., *Lycopodium clavatum* L., *Lycopodium complanatum* L., *Lycopodium dendroideum* Michx., *Lycopodium digitatum*, *Lycopodium xhabereri*, *Lycopodium hickeyi*, *Lycopodium xissleri*, *Lycopodium lagopus*, *Lycopodium obscurum* L., *Lycopodium phlegmaria* L., *Lycopodium sabinifolium*, *Lycopodium sitchense*, *Lycopodium tristachyum*, *Lycopodium venustulum*, *Lycopodium venustulum* var. *venustulum*, *Lycopodium venustulum* var. *verticale*, *Lycopodium volubile*, and *Lycopodium xzeilleri*.

In some embodiments IPD080 polypeptide is derived from a species in the Genus *Huperzia*. In some embodiments the IPD080 polypeptide is derived from a *Huperzia* species selected from but not limited to *Huperzia appressa*, *Huperzia arctica*, *Huperzia attenuata*, *Huperzia australiana*, *Huperzia balansae*, *Huperzia billardierei*, *Huperzia brassii*, *Huperzia campiana*, *Huperzia capellae*, *Huperzia carinata*, *Huperzia chinensis*, *Huperzia compacta*, *Huperzia crassa*, *Huperzia crispata*, *Huperzia cryptomeriana*, *Huperzia cumingii*, *Huperzia dacrydioides*, *Huperzia dalhousieana*, *Huperzia dichotoma*, *Huperzia emeiensis*, *Huperzia ericifolia*, *Huperzia eversa*, *Huperzia fargesii*, *Huperzia fordii*, *Huperzia funiformis*, *Huperzia goebellii*, *Huperzia haleakalae*, *Huperzia hamiltonii*, *Huperzia heteroclita*, *Huperzia hippuridea*, *Huperzia hippuris*, *Huperzia holstii*, *Huperzia horizontalis*, *Huperzia hunanensis*, *Huperzia hystrix*, *Huperzia lindenii*, *Huperzia linifolia*, *Huperzia lockyeri*, *Huperzia lucidula*, *Huperzia mingcheensis*, *Huperzia miyoshiana*, *Huperzia nanchuanensis*, *Huperzia nummulariifolia*, *Huperzia obtusifolia*, *Huperzia ophioglossoides*, *Huperzia petiolata*, *Huperzia phlegmaria*, *Huperzia phlegmarioides*, *Huperzia phyllantha*, *Huperzia pinifolia*, *Huperzia polydactyla*, *Huperzia prolifera*, *Huperzia reflexa*, *Huperzia rosenstockiana*, *Huperzia rufescens*, *Huperzia salvinoides*, *Huperzia sarmentosa*, *Huperzia selago*, *Huperzia serrata*, *Huperzia sieboldii*, *Huperzia somae*, *Huperzia squarrosa*, *Huperzia subulata*, *Huperzia sutchueniana*, *Huperzia tauri*, *Huperzia taxifolia*, *Huperzia tenuis*, *Huperzia tetragona*, *Huperzia tetrasticha*, *Huperzia unguiculata*, *Huperzia varia*, *Huperzia verticillata*, and *Huperzia wilsonii*.

In some embodiments, the IPD080 polypeptide is derived from a species in the Genus *Phlegmariurus*. In some embodiments the IPD080 polypeptide is derived from a *Phlegmariurus* species selected from but not limited to *Phlegmariurus afromontanus*, *Phlegmariurus aloifolius*, *Phlegmariurus balansae*, *Phlegmariurus bampsianus*, *Phlegmariurus banayanicus*, *Phlegmariurus bolanicus*, *Phlegmariurus brachystachys*, *Phlegmariurus*, *Phlegmariurus cancellatus*, *Phlegmariurus*, *Phlegmariurus cavifolius*, *Phlegmariurus coralium*, *Phlegmariurus creber*, *Phlegmariurus cryptomerinus*, *Phlegmariurus cunninghamioides*, *Phlegmariurus curiosus*, *Phlegmariurus dacrydioides*, *Phlegmariurus dalhousieanus*, *Phlegmariurus delbrueckii*, *Phlegmariurus dielsii*, *Phlegmariurus durus*, *Phlegmariurus ellenbeckii*, *Phlegmariurus elmeri*, *Phlegmariurus fargesii*, *Phlegmariurus filiformis*, *Phlegmariurus flagellaceus*, *Phlegmariurus foliosus*, *Phlegmariurus fordii*, *Phlegmariurus gagnepainianus*, *Phlegmariurus giganteus*, *Phlegmariurus gnidioides*, *Phlegmariurus goebelii*, *Phlegmariurus guandongensis*, *Phlegmariurus gunturensis*, *Phlegmariurus hamiltonii*, *Phlegmariurus harmsii*, *Phlegmariurus hellwigii*, *Phlegmariurus henryi*, *Phlegmariurus*

*hillianus, Phlegmariurus holstii, Phlegmariurus horizontalis, Phlegmariurus humbertii, Phlegmariurus humbertii-henrici, Phlegmariurus jaegeri, Phlegmariurus juniperistachyus, Phlegmariurus lauterbachii, Phlegmariurus lecomteanus, Phlegmariurus ledermannii, Phlegmariurus lockyeri, Phlegmariurus longus, Phlegmariurus, Phlegmariurus macgregorii, Phlegmariurus macrostachys, Phlegmariurus mannii, Phlegmariurus marsupiiformis, Phlegmariurus megastachyus, Phlegmariurus merrillii, Phlegmariurus milbraedii, Phlegmariurus mingcheensis, Phlegmariurus minutifolius, Phlegmariurus multifarius, Phlegmariurus myrtifolius, Phlegmariurus nanus, Phlegmariurus neocaledonicus, Phlegmariurus nilagiricus, Phlegmariurus nummulariifolius, Phlegmariurus nutans, Phlegmariurus nylamensis, Phlegmariurus obtusifolius, Phlegmariurus oceanianus, Phlegmariurus oltmannsii, Phlegmariurus ophioglossoides, Phlegmariurus ovatifolius, Phlegmariurus parksii, Phlegmariurus patentissimus, Phlegmariurus pecten, Phlegmariurus perrerianus, Phlegmariurus petiolatus, Phlegmariurus phlegmaria, Phlegmariurus, Phlegmariurus phyllanthus, Phlegmariurus pichianus, Phlegmariurus proliferus, Phlegmariurus pulcherrimus, Phlegmariurus ribourtii, Phlegmariurus rubricus, Phlegmariurus rupicola, Phlegmariurus salvinioides, Phlegmariurus samoanus, Phlegmariurus shangsiensis, Phlegmariurus schlechteri, Phlegmariurus setifolius, Phlegmariurus sieboldii, Phlegmariurus sooianus, Phlegmariurus squarrosus, Phlegmariurus staudtii, Phlegmariurus strictus, Phlegmariurus sub falciformis, Phlegmariurus subulifolius, Phlegmariurus subtrifoliatus, Phlegmariurus talamauanus, Phlegmariurus terrae-guilelmii, Phlegmariurus tetrastichus, Phlegmariurus tetrastichoides, Phlegmariurus toppingii, Phlegmariurus tournayanus, Phlegmariurus trifoliatus, Phlegmariurus trigonus, Phlegmariurus ulicifolius, Phlegmariurus varius, Phlegmariurus whitfordii, Phlegmariurus xiphophyllus,* and *Phlegmariurus yandongensis.*

"Sufficiently homologous" is used herein to refer to an amino acid sequence that has at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence homology compared to a reference sequence using one of the alignment programs described herein using standard parameters. In some embodiments, the sequence homology is against the full-length sequence of an IPD080 polypeptide.

In some embodiments the IPD080 polypeptide has at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344 or SEQ ID NO: 345. The term "about" when used herein in context with percent sequence identity means +1-0.5%. One of skill in the art will recognize that these values can be appropriately adjusted to determine corresponding homology of proteins considering amino acid similarity and the like.

In some embodiments, the sequence identity is calculated using ClustalW algorithm in the ALIGNX® module of the Vector NTI® Program Suite (Invitrogen Corporation, Carlsbad, Calif.) with all default parameters. In some embodiments, the sequence identity is across the entire length of polypeptide calculated using ClustalW algorithm in the ALIGNX® module of the Vector NTI® Program Suite (Invitrogen Corporation, Carlsbad, Calif.) with all default parameters.

As used herein, the terms "protein," "peptide molecule," or "polypeptide" includes any molecule that comprises five or more amino acids. It is well known in the art that protein, peptide or polypeptide molecules may undergo modification, including post-translational modifications, such as, but not limited to, disulfide bond formation, glycosylation, phosphorylation or oligomerization. Thus, as used herein, the terms "protein," "peptide molecule" or "polypeptide" includes any protein that is modified by any biological or non-biological process. The terms "amino acid" and "amino acids" refer to all naturally occurring L-amino acids.

A "recombinant protein" is used herein to refer to a protein that is no longer in its natural environment, for example in vitro or in a recombinant bacterial or plant host cell. An IPD080 polypeptide that is substantially free of cellular material includes preparations of protein having less than about 30%, 20%, 10% or 5% (by dry weight) of non-pesticidal protein (also referred to herein as a "contaminating protein").

"Fragments" or "biologically active portions" include polypeptide fragments comprising amino acid sequences sufficiently identical to an IPD080 polypeptide and that exhibit insecticidal activity. "Fragments" or "biologically active portions" of IPD080 polypeptides includes fragments comprising amino acid sequences sufficiently identical to the amino acid sequence set forth in IPD080 polypeptides of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344 or SEQ ID NO: 345, wherein the polypeptide has insecticidal activity. Such biologically active portions can be prepared by recombinant techniques and evaluated for insecticidal activity. In some embodiments, the IPD080 polypeptide fragment is an N-terminal and/or a C-terminal truncation of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31 or more amino acids from the N-terminus and/or C-terminus relative to IPD080 polypeptides of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO:

341, SEQ ID NO: 342, SEQ ID NO: 343, SEQ ID NO: 344 or SEQ ID NO: 345, e.g., by proteolysis, by insertion of a start codon, by deletion of the codons encoding the deleted amino acids and concomitant insertion of a start codon, and/or insertion of a stop codon. In some embodiments, the IPD080 polypeptide fragment is an N-terminal truncation of at least 1, 2, 3, 4, 5, 6, 7, 8, 9, 10, 11, 12, 13, 14, 15, 16, 17, 18, 19, 20, 21, 22, 23, 24 amino acids from the N-terminus of IPD080 polypeptides of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344 or SEQ ID NO: 345. In some embodiments, the IPD080 polypeptide fragment is an N-terminal and/or a C-terminal truncation of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34 or more amino acids from the N-terminus and/or C-terminus relative to IPD080 polypeptides of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344 or SEQ ID NO: 345.

"Variants" as used herein refers to proteins or polypeptides having an amino acid sequence that is at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater identical to the parental amino acid sequence.

In some embodiments an IPD080 polypeptide comprises an amino acid sequence having at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater identity to the amino acid sequence of IPD080 polypeptides of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344 or SEQ ID NO: 345, wherein the IPD080 polypeptide has insecticidal activity.

In some embodiments an IPD080 polypeptide comprises an amino acid sequence having at least about 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of the IPD080 polypeptide of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344 or SEQ ID NO: 345.

In some embodiments, the sequence identity is across the entire length of the polypeptide calculated using ClustalW algorithm in the ALIGNX® module of the Vector NTI® Program Suite (Invitrogen Corporation, Carlsbad, Calif.) with all default parameters.

In some embodiments, the IPD080 polypeptide comprises an amino acid sequence having at least about 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 160.

In some embodiments an IPD080 polypeptide comprises an amino acid sequence of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344 or SEQ ID NO: 345, having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35 or more amino acid substitutions, deletions and/or insertions compared to the native amino acid at the corresponding position of IPD080 polypeptides of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344 or SEQ ID NO: 345.

Methods for such manipulations are generally known in the art. For example, amino acid sequence variants of an IPD080 polypeptide can be prepared by mutations in the DNA. This may also be accomplished by one of several forms of mutagenesis and/or in directed evolution.

In some aspects, the changes encoded in the amino acid sequence will not substantially affect the function of the protein. Such variants will possess the desired pesticidal activity. However, it is understood that the ability of an IPD080 polypeptide to confer pesticidal activity may be improved using such techniques upon the compositions of this disclosure.

For example, conservative amino acid substitutions may be made at one or more predicted nonessential amino acid residues. A “nonessential” amino acid residue is a residue that can be altered from the wild-type sequence of an IPD080 polypeptide without altering the biological activity.

Alignment of the amino acid sequences of IPD080 polypeptide homologs (for example—FIGS. 1, 2, and 3), allows for the identification of residues that are highly conserved amongst the natural homologs of this family as well as residues or regions tolerant to amino acid diversity. A "conservative amino acid substitution" is one in which the amino acid residue is replaced with an amino acid residue having a similar side chain. Families of amino acid residues having similar side chains have been defined in the art. These families include: amino acids with basic side chains (e.g., lysine, arginine, histidine); acidic side chains (e.g., aspartic acid, glutamic acid); polar, negatively charged residues and their amides (e.g., aspartic acid, asparagine, glutamic, acid, glutamine; uncharged polar side chains (e.g., glycine, asparagine, glutamine, serine, threonine, tyrosine, cysteine); small aliphatic, nonpolar or slightly polar residues (e.g., Alanine, serine, threonine, proline, glycine); nonpolar side chains (e.g., alanine, valine, leucine, isoleucine, proline, phenylalanine, methionine, tryptophan); large aliphatic, nonpolar residues (e.g., methionine, leucine, isoleucine, valine, cystine); beta-branched side chains (e.g., threonine, valine, isoleucine); aromatic side chains (e.g., tyrosine, phenylalanine, tryptophan, histidine); large aromatic side chains (e.g., tyrosine, phenylalanine, tryptophan).

Amino acid substitutions may be made in nonconserved regions that retain function. In general, such substitutions would not be made for conserved amino acid residues or for amino acid residues residing within a conserved motif, where such residues are essential for protein activity. Examples of residues that are conserved and that may be essential for protein activity include, for example, residues that are identical between all proteins contained in an alignment of similar or related toxins to the sequences of the embodiments (e.g., residues that are identical in an alignment of homologous proteins). Examples of residues that are conserved but that may allow conservative amino acid substitutions and still retain activity include, for example, residues that have only conservative substitutions between all proteins contained in an alignment of similar or related toxins to the sequences of the embodiments (e.g., residues that have only conservative substitutions between all proteins contained in the alignment homologous proteins). However, one of skill in the art would understand that functional variants may have minor conserved or nonconserved alterations in the conserved residues. Guidance as to appropriate amino acid substitutions that do not affect biological activity of the protein of interest may be found in the model of Dayhoff, et al., (1978) *Atlas of Protein Sequence and Structure* (Natl. Biomed. Res. Found., Washington, D.C.), herein incorporated by reference.

In making such changes, the hydropathic index of amino acids may be considered. The importance of the hydropathic amino acid index in conferring interactive biologic function on a protein is generally understood in the art (Kyte and Doolittle, (1982) *J Mol Biol.* 157(1):105-32). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like.

It is known in the art that certain amino acids may be substituted by other amino acids having a similar hydropathic index or score and still result in a protein with similar biological activity, i.e., still obtain a biological functionally equivalent protein. Each amino acid has been assigned a hydropathic index based on its hydrophobicity and charge characteristics (Kyte and Doolittle, ibid). These are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9) and arginine (−4.5). In making such changes, the substitution of amino acids whose hydropathic indices are within +2 is preferred, those which are within +1 are particularly preferred, and those within +0.5 are even more particularly preferred.

It is also understood in the art that the substitution of like amino acids can be made effectively based on hydrophilicity. U.S. Pat. No. 4,554,101, states that the greatest local average hydrophilicity of a protein, as governed by the hydrophilicity of its adjacent amino acids, correlates with a biological property of the protein.

As detailed in U.S. Pat. No. 4,554,101, the following hydrophilicity values have been assigned to amino acid residues: arginine (+3.0); lysine (+3.0); aspartate (+3.0.+0.1); glutamate (+3.0.+0.1); serine (+0.3); asparagine (+0.2); glutamine (+0.2); glycine (0); threonine (−0.4); proline (−0.5.+0.1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4).

Alternatively, alterations may be made to the protein sequence of many proteins at the amino or carboxy terminus without substantially affecting activity. This can include insertions, deletions or alterations introduced by modern molecular methods, such as PCR, including PCR amplifications that alter or extend the protein coding sequence by inclusion of amino acid encoding sequences in the oligonucleotides utilized in the PCR amplification. Alternatively, the protein sequences added can include entire protein-coding sequences, such as those used commonly in the art to generate protein fusions. Such fusion proteins are often used to (1) increase expression of a protein of interest (2) introduce a binding domain, enzymatic activity or epitope to facilitate either protein purification, protein detection or other experimental uses known in the art (3) target secretion or translation of a protein to a subcellular organelle, such as the periplasmic space of Gram-negative bacteria, mitochondria or chloroplasts of plants or the endoplasmic reticulum of eukaryotic cells, the latter of which often results in glycosylation of the protein.

Variant nucleotide and amino acid sequences of the disclosure also encompass sequences derived from mutagenic and recombinogenic procedures such as DNA shuffling. With such a procedure, one or more different IPD080 polypeptide coding regions can be used to create a new IPD080 polypeptide possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between a pesticidal gene and other known pesticidal genes to obtain a new gene coding for a protein with an improved property of interest, such as an increased insecticidal activity. Strategies for such DNA shuffling are known in the art. See, for example, Stemmer, (1994) *Proc. Natl. Acad. Sci. USA* 91:10747-10751; Stemmer, (1994) *Nature* 370:389-391; Crameri, et al., (1997) *Nature Biotech.* 15:436-438; Moore, et al., (1997) *J. Mol. Biol.* 272:336-347; Zhang, et al., (1997) *Proc. Natl. Acad. Sci. USA* 94:4504-4509; Crameri, et al., (1998) *Nature* 391:288-291; and U.S. Pat. Nos. 5,605,793 and 5,837,458.

Domain swapping or shuffling is another mechanism for generating altered IPD080 polypeptides. Domains may be swapped between IPD080 polypeptides resulting in hybrid or chimeric toxins with improved insecticidal activity or target spectrum. Methods for generating recombinant proteins and testing them for pesticidal activity are well known in the art (see, for example, Naimov, et al., (2001) *Appl. Environ. Microbiol.* 67:5328-5330; de Maagd, et al., (1996) *Appl. Environ. Microbiol.* 62:1537-1543; Ge, et al., (1991) *J. Biol. Chem.* 266:17954-17958; Schnepf, et al., (1990) *J. Biol. Chem.* 265:20923-20930; Rang, et al., 91999) *Appl. Environ. Microbiol.* 65:2918-2925).

Phylogenetic, sequence motif, and structural analyses of insecticidal protein families. A sequence and structure analysis method can be employed, which is composed of four components: phylogenetic tree construction, protein sequence motifs finding, secondary structure prediction, and alignment of protein sequences and secondary structures. Details about each component are illustrated below.

1) Phylogenetic Tree Construction

The phylogenetic analysis can be performed using the software MEGA5. Protein sequences can be subjected to ClustalW version 2 analysis (Larkin M. A et al (2007) *Bioinformatics* 23(21): 2947-2948) for multiple sequence alignment. The evolutionary history is then inferred by the Maximum Likelihood method based on the JTT matrix-based model. The tree with the highest log likelihood is obtained, exported in Newick format, and further processed to extract the sequence IDs in the same order as they appeared in the tree. A few clades representing sub-families can be manually identified for each insecticidal protein family.

2) Protein Sequence Motifs Finding

Protein sequences are re-ordered according to the phylogenetic tree built previously, and fed to the MOTIF analysis tool MEME (Multiple EM for MOTIF Elicitation) (Bailey T. L., and Elkan C., *Proceedings of the Second International Conference on Intelligent Systems for Molecular Biology*, pp. 28-36, AAAI Press, Menlo Park, Calif., 1994) for identification of key sequence motifs. MEME is setup as follows: Minimum number of sites 2, Minimum motif width 5, and Maximum number of motifs 30. Sequence motifs unique to each sub-family were identified by visual observation. The distribution of MOTIFs across the entire gene family could be visualized in HTML webpage. The MOTIFs are numbered relative to the ranking of the E-value for each MOTIF.

3) Secondary Structure Prediction

PSIPRED, top ranked secondary structure prediction method (Jones D T. (1999) *J. Mol. Biol.* 292: 195-202), can be used for protein secondary structure prediction. The tool provides accurate structure prediction using two feed-forward neural networks based on the PSI-BLAST output. The PSI-BLAST database is created by removing low-complexity, transmembrane, and coiled-coil regions in Uniref100. The PSIPRED results contain the predicted secondary structures (Alpha helix: H, Beta strand: E, and Coil: C) and the corresponding confidence scores for each amino acid in a given protein sequence.

4) Alignment of Protein Sequences and Secondary Structures

A script can be developed to generate gapped secondary structure alignment according to the multiple protein sequence alignment from step 1 for all proteins. All aligned protein sequences and structures are concatenated into a single FASTA file, and then imported into MEGA for visualization and identification of conserved structures.

In some embodiments, the IPD080 polypeptide has a modified physical property. As used herein, the term "physical property" refers to any parameter suitable for describing the physical-chemical characteristics of a protein. As used herein, "physical property of interest" and "property of interest" are used interchangeably to refer to physical properties of proteins that are being investigated and/or modified. Examples of physical properties include, but are not limited to, net surface charge and charge distribution on the protein surface, net hydrophobicity and hydrophobic residue distribution on the protein surface, surface charge density, surface hydrophobicity density, total count of surface ionizable groups, surface tension, protein size and its distribution in solution, melting temperature, heat capacity, and second virial coefficient. Examples of physical properties also include, IPD080 polypeptide having increased expression, increased solubility, decreased phytotoxicity, and digestibility of proteolytic fragments in an insect gut. Models for digestion by simulated gastric fluids are known to one skilled in the art (Fuchs, R. L. and J. D. Astwood. *Food Technology* 50: 83-88, 1996; Astwood, J. D., et al *Nature Biotechnology* 14: 1269-1273, 1996; Fu T J et al J. *Agric Food Chem.* 50: 7154-7160, 2002).

In some embodiments variants include polypeptides that differ in amino acid sequence due to mutagenesis. Variant proteins encompassed by the disclosure are biologically active, that is they continue to possess the desired biological activity (i.e. pesticidal activity) of the native protein. In some embodiment, the variant will have at least about 10%, at least about 30%, at least about 50%, at least about 70%, at least about 80% or more of the insecticidal activity of the native protein. In some embodiments, the variants may have improved activity over the native protein.

Bacterial genes quite often possess multiple methionine initiation codons in proximity to the start of the open reading frame. Often, translation initiation at one or more of these start codons will lead to generation of a functional protein. These start codons can include ATG codons. However, bacteria such as *Bacillus* sp. also recognize the codon GTG as a start codon, and proteins that initiate translation at GTG codons contain a methionine at the first amino acid. On rare occasions, translation in bacterial systems can initiate at a TTG codon, though in this event the TTG encodes a methionine. Furthermore, it is not often determined a priori which of these codons are used naturally in the bacterium. Thus, it is understood that use of one of the alternate methionine codons may also lead to generation of pesticidal proteins. These pesticidal proteins are encompassed in the present disclosure and may be used in the methods of the present disclosure. It will be understood that, when expressed in plants, it will be necessary to alter the alternate start codon to ATG for proper translation.

One skilled in the art understands that the polynucleotide coding sequence can be modified to add a codon at the penultimate position following the methionine start codon to create a restriction enzyme site for recombinant cloning purposes and/or for expression purposes. In some embodiments, the IPD080 polypeptide further comprises an alanine residue at the position after the translation initiator methionine.

In some embodiments, the translation initiator methionine of the IPD080 polypeptide is cleaved off post translationally. One skilled in the art understands that the N-terminal translation initiator methionine can be removed by methionine aminopeptidase in many cellular expression systems.

In some embodiments the IPD080 polypeptide comprises the amino acid sequence of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344 or SEQ ID NO: 345.

In some embodiments, chimeric polypeptides are provided comprising regions of at least two different IPD080 polypeptides of the disclosure.

In some embodiments, chimeric polypeptides are provided comprising regions of at least two different IPD080 polypeptides selected from SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, and SEQ ID NO: 345.

In some embodiments, chimeric IPD080 polypeptide are provided comprising an N-terminal Region of a first IPD080 polypeptide of the disclosure operably fused to a C-terminal Region of a second IPD080 polypeptide of the disclosure.

In some embodiments, chimeric IPD080 polypeptide are provided comprising an N-terminal Region of a first IPD080 polypeptide operably fused to a C-terminal Region of a second IPD080 polypeptide, where the first and second IPD080 polypeptide is selected from SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, and SEQ ID NO: 345.

In other embodiments, the IPD080 polypeptide may be expressed as a precursor protein with an intervening sequence that catalyzes multi-step, post translational protein splicing. Protein splicing involves the excision of an intervening sequence from a polypeptide with the concomitant joining of the flanking sequences to yield a new polypeptide (Chong, et al., (1996) *J. Biol. Chem.*, 271:22159-22168). This intervening sequence or protein splicing element, referred to as inteins, which catalyze their own excision through three coordinated reactions at the N-terminal and C-terminal splice junctions: an acyl rearrangement of the N-terminal cysteine or serine; a transesterfication reaction between the two termini to form a branched ester or thioester intermediate and peptide bond cleavage coupled to cyclization of the intein C-terminal asparagine to free the intein (Evans, et al., (2000) *J. Biol. Chem.*, 275:9091-9094. The elucidation of the mechanism of protein splicing has led to a number of intein-based applications (Comb, et al., U.S. Pat. No. 5,496,714; Comb, et al., U.S. Pat. No. 5,834,247; Camarero and Muir, (1999) *J. Amer. Chem. Soc.* 121:5597-5598; Chong, et al., (1997) *Gene* 192:271-281, Chong, et al., (1998) *Nucleic Acids Res.* 26:5109-5115; Chong, et al., (1998) *J. Biol. Chem.* 273:10567-10577; Cotton, et al., (1999) *J. Am. Chem. Soc.* 121:1100-1101; Evans, et al., (1999) *J. Biol. Chem.* 274:18359-18363; Evans, et al., (1999) *J. Biol. Chem.* 274:3923-3926; Evans, et al., (1998) *Protein Sci.* 7:2256-2264; Evans, et al., (2000) *J. Biol. Chem.* 275:9091-9094; Iwai and Pluckthun, (1999) *FEBS Lett.* 459:166-172; Mathys, et al., (1999) *Gene* 231:1-13; Mills, et al., (1998) *Proc. Natl. Acad. Sci. USA* 95:3543-3548; Muir, et al., (1998) *Proc. Natl. Acad. Sci. USA* 95:6705-6710; Otomo, et al., (1999) *Biochemistry* 38:16040-16044; Otomo, et al., (1999) *J. Biolmol. NMR* 14:105-114; Scott, et al., (1999) *Proc. Natl. Acad. Sci. USA* 96:13638-13643; Severinov and Muir, (1998) *J. Biol. Chem.* 273:16205-16209; Shingledecker, et al., (1998) *Gene* 207: 187-195; Southworth, et al., (1998) *EMBO J.* 17:918-926; Southworth, et al., (1999) *Biotechniques* 27:110-120; Wood, et al., (1999) *Nat. Biotechnol.* 17:889-892; Wu, et al., (1998a) *Proc. Natl. Acad. Sci. USA* 95:9226-9231; Wu, et al., (1998b) *Biochim Biophys Acta* 1387:422-432; Xu, et al., (1999) *Proc. Natl. Acad. Sci. USA* 96:388-393; Yamazaki, et al., (1998) *J. Am. Chem. Soc.,* 120:5591-5592). For the application of inteins in plant transgenes, see, Yang, et al., (*Transgene Res* 15:583-593 (2006)) and Evans, et al., (*Annu. Rev. Plant Biol.* 56:375-392 (2005)).

In another embodiment, the IPD080 polypeptide may be encoded by two separate genes where the intein of the precursor protein comes from the two genes, referred to as a split-intein, and the two portions of the precursor are joined by a peptide bond formation. This peptide bond formation is accomplished by intein-mediated trans-splicing. For this purpose, a first and a second expression cassette comprising the two separate genes further code for inteins capable of mediating protein trans-splicing. By trans-splicing, the proteins and polypeptides encoded by the first and second fragments may be linked by peptide bond formation. Trans-splicing inteins may be selected from the nucleolar and organellar genomes of different organisms including eukaryotes, archaebacteria and eubacteria. Inteins that may be used for are listed at neb.com/neb/inteins.html, which can be accessed on the world-wide web using the "www" prefix). The nucleotide sequence coding for an intein may be split into a 5' and a 3' part that code for the 5' and the 3' part of the intein, respectively. Sequence portions not necessary for intein splicing (e.g. homing endonuclease domain) may be deleted. The intein coding sequence is split such that the 5' and the 3' parts are capable of trans-splicing. For selecting a suitable splitting site of the intein coding sequence, the considerations published by Southworth, et al., (1998) EMBO J. 17:918-926 may be followed. In constructing the first and the second expression cassette, the 5' intein coding sequence is linked to the 3' end of the first fragment coding for the N-terminal part of the IPD080 polypeptide and the 3' intein coding sequence is linked to the 5' end of the second fragment coding for the C-terminal part of the IPD080 polypeptide.

In general, the trans-splicing partners can be designed using any split intein, including any naturally-occurring or artificially-split split intein. Several naturally-occurring split inteins are known, for example: the split intein of the DnaE gene of *Synechocystis* sp. PCC6803 (see, Wu, et al., (1998) *Proc Natl Acad Sci USA.* 95(16):9226-31 and Evans, et al., (2000) *J Biol Chem.* 275(13):9091-4 and of the DnaE gene from *Nostoc punctiforme* (see, Iwai, et al., (2006) *FEBS Lett.* 580(7):1853-8). Non-split inteins have been artificially split in the laboratory to create new split inteins, for example: the artificially split Ssp DnaB intein (see, Wu, et al., (1998) *Biochim Biophys Acta.* 1387:422-32) and split Sce VMA intein (see, Brenzel, et al., (2006) *Biochemistry.* 45(6):1571-8) and an artificially split fungal mini-intein (see, Elleuche, et al., (2007) *Biochem Biophys Res Commun.* 355(3):830-4). There are also intein databases available that catalogue known inteins (see for example the online-database available at: bioinformatics.weizmann.ac.il/~pietro/inteins/Inteinstable.html, which can be accessed on the world-wide web using the "www" prefix).

Naturally-occurring non-split inteins may have endonuclease or other enzymatic activities that can typically be removed when designing an artificially-split split intein. Such mini-inteins or minimized split inteins are well known in the art and are typically less than 200 amino acid residues long (see, Wu, et al., (1998) *Biochim Biophys Acta.* 1387:422-32). Suitable split inteins may have other purification enabling polypeptide elements added to their structure, if such elements do not inhibit the splicing of the split intein or are added in a manner that allows them to be removed prior to splicing. Protein splicing has been reported using proteins that comprise bacterial intein-like (BIL) domains (see, Amitai, et al., (2003) *Mol Microbiol.* 47:61-73) and hedgehog (Hog) auto-processing domains (the latter is combined with inteins when referred to as the Hog/intein superfamily or HINT family (see, Dassa, et al., (2004) *J Biol Chem.* 279:32001-7) and domains such as these may also be used to prepare artificially-split inteins. In particular, non-splicing members of such families may be modified by molecular biology methodologies to introduce or restore splicing activity in such related species. Recent studies demonstrate that splicing can be observed when a N-terminal split intein component can react with a C-terminal split intein component not found in nature to be its "partner"; for example, splicing has been observed utilizing partners that have as little as 30 to 50% homology with the "natural" splicing partner (see, Dassa, et al., (2007) *Biochemistry.* 46(1):322-30). Other such mixtures of disparate split intein partners have been shown to be unreactive one with another (see, Brenzel, et al., (2006) *Biochemistry.* 45(6):1571-8). However, it is within the ability of a person skilled in the relevant art to determine whether a pair of polypeptides can associate with each other to provide a functional intein, using routine methods and without the exercise of inventive skill.

In some embodiments, the IPD080 polypeptide is a circular permuted variant. In certain embodiments the IPD080 polypeptide is a circular permuted variant of the polypeptide of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, and SEQ ID NO: 345, or variant thereof having an amino acid substitution, deletion, addition or combinations thereof. The development of recombinant DNA methods has made it possible to study the effects of sequence transposition on protein folding, structure and function. The approach used in creating new sequences resembles that of naturally occurring pairs of proteins that are related by linear reorganization of their amino acid sequences (Cunningham, et al., (1979) *Proc. Natl. Acad. Sci. U.S.A.* 76:3218-3222; Teather and Erfle, (1990) *J. Bacteriol.* 172:3837-3841; Schimming, et al., (1992) *Eur. J. Biochem.* 204:13-19; Yamiuchi and Minamikawa, (1991) *FEBS Lett.* 260:127-130; MacGregor, et al., (1996) *FEBS Lett.* 378:263-266). The first in vitro application of this type of rearrangement to proteins was described by Goldenberg and Creighton (*J. Mol. Biol.* 165: 407-413, 1983). In creating a circular permuted variant, a new N-terminus is selected at an internal site (breakpoint) of the original sequence, the new sequence having the same order of amino acids as the original from the breakpoint until it reaches an amino acid that is at or near the original C-terminus. At this point the new sequence is joined, either directly or through an additional portion of sequence (linker), to an amino acid that is at or near the original N-terminus and the new sequence continues with the same sequence as the original until it reaches a point that is at or near the amino acid that was N-terminal to the breakpoint site of the original sequence, this residue forming the new C-terminus of the chain. The length of the amino acid sequence of the linker can be selected empirically or with guidance from structural information or by using a combination of the two approaches. When no structural information is available, a small series of linkers can be prepared for testing using a design whose length is varied to span a range from 0 to 50 Å and whose sequence is chosen to be consistent with surface exposure (hydrophilicity, Hopp and Woods, (1983) *Mol. Immunol.* 20:483-489; Kyte and Doolittle, (1982) *J. Mol. Biol.* 157:105-132; solvent exposed surface area, Lee and Richards, (1971) *J. Mol. Biol.* 55:379-400) and the ability to adopt the necessary conformation without deranging the configuration of the pesticidal polypeptide (conformationally flexible; Karplus and Schulz, (1985) *Naturwissenschaften* 72:212-213). Assuming an average of translation of 2.0 to 3.8 Å per residue, this would mean the length to test would be between 0 to 30 residues, with 0 to 15 residues being the preferred range. Exemplary of such an empirical series would be to construct linkers using a cassette sequence such as Gly-Gly-Gly-Ser repeated n times, where n is 1, 2, 3 or 4. Those skilled in the art will recognize that there are many such sequences that vary in length or composition that can serve as linkers with the primary consideration being that they be neither excessively long nor short (cf., Sandhu, (1992) *Critical Rev. Biotech.* 12:437-462); if they are too long, entropy effects will likely destabilize the three-dimensional fold, and may also make folding kinetically impractical, and if they are too short, they will likely destabilize the molecule because of torsional or steric strain. Those skilled in the analysis of protein structural information will recognize that using the distance between the chain ends, defined as the distance between the c-alpha carbons, can be used to define the length of the sequence to be used or at least to limit the number of possibilities that must be tested in an empirical selection of linkers. They will also recognize that it is sometimes the case that the positions of the ends of the polypeptide chain are ill-defined in structural models derived from x-ray diffraction or nuclear magnetic resonance spectroscopy data, and that when true, this situation will therefore need to be considered to properly estimate the length of the linker required. From those residues, whose positions are well defined are selected two residues that are close in sequence to the chain ends, and the distance between their c-alpha carbons is used to calculate an approximate length for a linker between them. Using the calculated length as a guide, linkers with a range of number of residues (calculated using 2 to 3.8 Å per residue) are then selected. These linkers may be composed of the original sequence, shortened or lengthened as necessary, and when lengthened the additional residues may be chosen to be flexible and hydrophilic as described above; or optionally the original sequence may be substituted for using a series of linkers, one example being the Gly-Gly-Gly-Ser cassette approach mentioned above; or optionally a combination of the original sequence and new sequence having the appropriate total length may be used. Sequences of pesticidal polypeptides capable of folding to biologically active states can be prepared by appropriate selection of the beginning (amino terminus) and ending (carboxyl terminus) positions from within the original polypeptide chain while using the linker sequence as described above. Amino and carboxyl termini are selected from within a common stretch of sequence, referred to as a breakpoint region, using the guidelines described below. A novel amino acid sequence is thus generated by selecting amino and carboxyl termini from within the same breakpoint region. In many cases the selection of the new termini will be such that the original position of the carboxyl terminus immediately preceded that of the amino terminus. However, those skilled in the art will recognize that selections of termini anywhere within the region may function, and that these will effectively lead to either deletions or additions to the amino or carboxyl portions of the new sequence. It is a central tenet of molecular biology that the primary amino acid sequence of a protein dictates folding to the three-dimensional structure necessary for expression of its biological function. Methods are known to those skilled in the art to obtain and interpret three-dimensional structural information using x-ray diffraction of single protein Crystals or nuclear magnetic resonance spectroscopy of protein solutions. Examples of structural information that are relevant to the identification of breakpoint regions include the location and type of protein secondary structure (alpha and 3-10 helices, parallel and anti-parallel beta sheets, chain reversals and turns, and loops; Kabsch and Sander, (1983) *Biopolymers* 22:2577-2637; the degree of solvent exposure of amino acid residues, the extent and type of interactions of residues with one another (Chothia, (1984) *Ann. Rev. Biochem.* 53:537-572) and the static and dynamic distribution of conformations along the polypeptide chain (Alber and Mathews, (1987) *Methods Enzymol.* 154:511-533). In some cases, additional information is known about solvent exposure of residues; one example is a site of post-translational attachment of carbohydrate which is necessarily on the surface of the protein. When experimental structural information is not available or is not feasible to obtain, methods are also available to analyze the primary amino acid sequence to make predictions of protein tertiary and secondary structure, solvent accessibility and the occurrence of turns and loops. Biochemical methods are also sometimes applicable for empirically determining surface exposure when direct structural methods are not feasible; for example, using the identification of sites of chain scission following limited proteolysis to infer surface exposure (Gentile and Salvatore, (1993) *Eur. J. Biochem.* 218:603-621). Thus, using either the experimentally derived structural information or predictive methods (e.g., Srinivisan and Rose, (1995) *Proteins: Struct., Fund. &Genetics* 22:81-99) the parental amino acid sequence is inspected to classify regions according to whether they are integral to the maintenance of secondary and tertiary structure. The occurrence of sequences within regions that are known to be involved in periodic secondary structure (alpha and 3-10 helices, parallel and anti-parallel beta sheets) are regions that should be avoided. Similarly, regions of amino acid sequence that are observed or predicted to have a low degree of solvent exposure are more likely to be part of the so-called hydrophobic core of the protein and should also be avoided for selection of amino and carboxyl termini. In contrast, those regions that are known or predicted to be in surface turns or loops, and especially those regions that are known not to be required for biological activity, are the preferred sites for location of the extremes of the polypeptide chain. Continuous stretches of amino acid sequence that are preferred based on the above criteria are referred to as a breakpoint region. Polynucleotides encoding circular permuted IPD080 polypeptides with new N-terminus/C-terminus which contain a linker region separating the original C-terminus and N-terminus can be made essentially following the method described in Mullins, et al., (1994) *J. Am. Chem. Soc.* 116:5529-5533. Multiple steps of polymerase chain reaction (PCR) amplifications are used to rearrange the DNA sequence encoding the primary amino acid sequence of the protein. Polynucleotides encoding circular permuted IPD080 polypeptides with new N-terminus/C-terminus which contain a linker region separating the original C-terminus and N-terminus can be made based on the tandem-duplication method described in Horlick, et al., (1992) *Protein Eng.* 5:427-431. Polymerase chain reaction (PCR) amplification of the new N-terminus/C-terminus genes is performed using a tandemly duplicated template DNA.

In another embodiment, fusion proteins are provided that include within its amino acid sequence an amino acid sequence comprising an IPD080 polypeptide or chimeric IPD080 polypeptide of the disclosure. Methods for design and construction of fusion proteins (and polynucleotides encoding same) are known to those of skill in the art. Polynucleotides encoding an IPD080 polypeptide may be fused to signal sequences which will direct the localization of the IPD080 polypeptide to particular compartments of a prokaryotic or eukaryotic cell and/or direct the secretion of the IPD080 polypeptide of the embodiments from a prokaryotic or eukaryotic cell. For example, in *E. coli*, one may wish to direct the expression of the protein to the periplasmic space. Examples of signal sequences or proteins (or fragments thereof) to which the IPD080 polypeptide may be fused to direct the expression of the polypeptide to the periplasmic space of bacteria include, but are not limited to, the pelB signal sequence, the maltose binding protein (MBP) signal sequence, MBP, the ompA signal sequence, the signal sequence of the periplasmic *E. coli* heat-labile enterotoxin B-subunit and the signal sequence of alkaline phosphatase. Several vectors are commercially available for the construction of fusion proteins which will direct the localization of a protein, such as the pMAL series of vectors (particularly the pMAL-p series) available from New England Biolabs. In a specific embodiment, the IPD080 polypeptide may be fused to the pelB pectate lyase signal sequence to increase the efficiency of expression and purification of such polypeptides in Gram-negative bacteria (see, U.S. Pat. Nos. 5,576,195 and 5,846,818). Plant plastid transit peptide/polypeptide fusions are well known in the art. Apoplast transit peptides such as rice or barley alpha-amylase secretion signal are also well known in the art. The plastid transit peptide is generally fused N-terminal to the polypeptide to be targeted (e.g., the fusion partner). In one embodiment, the fusion protein consists essentially of the plastid transit peptide and the IPD080 polypeptide to be targeted. In another embodiment, the fusion protein comprises the plastid transit peptide and the polypeptide to be targeted. In such embodiments, the plastid transit peptide is preferably at the N-terminus of the fusion protein. However, additional amino acid residues may be N-terminal to the plastid transit peptide if the fusion protein is at least partially targeted to a plastid. In a specific embodiment, the plastid transit peptide is in the N-terminal half, N-terminal third or N-terminal quarter of the fusion protein. Most or all of the plastid transit peptide is generally cleaved from the fusion protein upon insertion into the plastid. The position of cleavage may vary slightly between plant species, at different plant developmental stages, because of specific intercellular conditions or the combination of transit peptide/fusion partner used. In one embodiment, the plastid transit peptide cleavage is homogenous such that the cleavage site is identical in a population of fusion proteins. In another embodiment, the plastid transit peptide is not homogenous, such that the cleavage site varies by 1-10 amino acids in a population of fusion proteins. The plastid transit peptide can be recombinantly fused to a second protein in one of several ways. For example, a restriction endonuclease recognition site can be introduced into the nucleotide sequence of the transit peptide at a position corresponding to its C-terminal end and the same or a compatible site can be engineered into the nucleotide sequence of the protein to be targeted at its N-terminal end. Care must be taken in designing these sites to ensure that the coding sequences of the transit peptide and the second protein are kept "in frame" to allow the synthesis of the desired fusion protein. In some cases, it may be preferable to remove the initiator methionine of the second protein when the new restriction site is introduced. The introduction of restriction endonuclease recognition sites on both parent molecules and their subsequent joining through recombinant DNA techniques may result in the addition of one or more extra amino acids between the transit peptide and the second protein. This generally does not affect targeting activity if the transit peptide cleavage site remains accessible and the function of the second protein is not altered by the addition of these extra amino acids at its N-terminus. Alternatively, one skilled in the art can create a precise cleavage site between the transit peptide and the second protein (with or without its initiator methionine) using gene synthesis (Stemmer, et al., (1995) Gene 164:49-53) or similar methods. In addition, the transit peptide fusion can intentionally include amino acids downstream of the cleavage site. The amino acids at the N-terminus of the mature protein can affect the ability of the transit peptide to target proteins to plastids and/or the efficiency of cleavage following protein import. This may be dependent on the protein to be targeted. See, e.g., Comai, et al., (1988) *J. Biol. Chem.* 263(29):15104-9. In some embodiments, the IPD080 polypeptide is fused to a heterologous signal peptide or heterologous transit peptide.

In some embodiments, fusion proteins are provide comprising an IPD080 polypeptide or chimeric IPD080 polypeptide of the disclosure represented by a formula selected from the group consisting of:

$$R^1\text{-}L\text{-}R^2,\ R^2\text{-}L\text{-}R^1,\ R^1\text{—}R^2 \text{ or } R^2\text{—}R^1$$

wherein $R^1$ is an IPD080 polypeptide or chimeric IPD080 polypeptide of the disclosure and $R^2$ is a protein of interest. In some embodiments $R^1$ and $R^2$ are an IPD080 polypeptide or chimeric IPD080 polypeptide of the disclosure. The $R^1$ polypeptide is fused either directly or through a linker (L) segment to the $R^2$ polypeptide. The term "directly" defines fusions in which the polypeptides are joined without a peptide linker. Thus "L" represents a chemical bound or polypeptide segment to which both $R^1$ and $R^2$ are fused in frame, most commonly L is a linear peptide to which $R^1$ and $R^2$ are bound by amide bonds linking the carboxy terminus of $R^1$ to the amino terminus of L and carboxy terminus of L to the amino terminus of $R^2$. By "fused in frame" is meant that there is no translation termination or disruption between the reading frames of $R^1$ and $R^2$. The linking group (L) is generally a polypeptide of between 1 and 500 amino acids in length. The linkers joining the two molecules are preferably designed to (1) allow the two molecules to fold and act independently of each other, (2) not have a propensity for developing an ordered secondary structure which could interfere with the functional domains of the two proteins, (3) have minimal hydrophobic or charged characteristic which could interact with the functional protein domains and (4) provide steric separation of $R^1$ and $R^2$ such that $R^1$ and $R^2$ could interact simultaneously with their corresponding receptors on a single cell. Typically surface amino acids in flexible protein regions include Gly, Asn and Ser. Virtually any permutation of amino acid sequences containing Gly, Asn and Ser would be expected to satisfy the above criteria for a linker sequence. Other neutral amino acids, such as Thr and Ala, may also be used in the linker sequence. Additional amino acids may also be included in the linkers due to the addition of unique restriction sites in the linker sequence to facilitate construction of the fusions.

In some embodiments, the linkers comprise sequences selected from the group of formulas: $(Gly_3Ser)_n$, $(Gly_4Ser)_n$, $(Gly_5Ser)_n$, $(GlynSer)_n$ or $(AlaGlySer)_n$ where n is an integer. One example of a highly-flexible linker is the (GlySer)-rich spacer region present within the pIII protein of the filamentous bacteriophages, e.g. bacteriophages M13 or fd (Schaller, et al., 1975). This region provides a long, flexible spacer region between two domains of the pIII surface protein. Also included are linkers in which an endopeptidase recognition sequence is included. Such a cleavage site may be valuable to separate the individual components of the fusion to determine if they are properly folded and active in vitro. Examples of various endopeptidases include, but are not limited to, Plasmin, Enterokinase, Kallikerin, Urokinase, Tissue Plasminogen activator, clostripain, Chymosin, Collagenase, Russell's Viper Venom Protease, Postproline cleavage enzyme, V8 protease, Thrombin and factor Xa. In some embodiments, the linker comprises the amino acids EEKKN (SEQ ID NO: 325) from the multi-gene expression vehicle (MGEV), which is cleaved by vacuolar proteases as disclosed in US Patent Application Publication Number US 2007/0277263. In other embodiments, peptide linker segments from the hinge region of heavy chain immunoglobulins IgG, IgA, IgM, IgD or IgE provide an angular relationship between the attached polypeptides. Especially useful are those hinge regions where the cysteines are replaced with serines. Linkers of the present disclosure include sequences derived from murine IgG gamma 2b hinge region in which the cysteines have been changed to serines. The fusion proteins are not limited by the form, size or number of linker sequences employed and the only requirement of the linker is that functionally it does not interfere adversely with the folding and function of the individual molecules of the fusion.

Nucleic Acid Molecules, and Variants and Fragments Thereof

Isolated or recombinant nucleic acid molecules comprising nucleic acid sequences encoding IPD080 polypeptides or biologically active portions thereof, as well as nucleic acid molecules sufficient for use as hybridization probes to identify nucleic acid molecules encoding proteins with regions of sequence homology are provided. As used herein, the term "nucleic acid molecule" refers to DNA molecules (e.g., recombinant DNA, cDNA, genomic DNA, plastid DNA, mitochondrial DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" nucleic acid molecule (or DNA) is used herein to refer to a nucleic acid sequence (or DNA) that is no longer in its natural environment, for example in vitro. A "recombinant" nucleic acid molecule (or DNA) is used herein to refer to a nucleic acid sequence (or DNA) that is in a recombinant bacterial or plant host cell. In some embodiments, an "isolated" or "recombinant" nucleic acid is free of sequences (preferably protein encoding sequences) that naturally flank the nucleic acid (i.e., sequences located at the 5' and 3' ends of the nucleic acid) in the genomic DNA of the organism from which the nucleic acid is derived. For purposes of the disclosure, "isolated" or "recombinant" when used to refer to nucleic acid molecules excludes isolated chromosomes. For example, in various embodiments, the recombinant nucleic acid molecules encoding IPD080 polypeptides can contain less than about 5 kb, 4 kb, 3 kb, 2 kb, 1 kb, 0.5 kb or 0.1 kb of nucleic acid sequences that naturally flank the nucleic acid molecule in genomic DNA of the cell from which the nucleic acid is derived.

In some embodiments, an isolated nucleic acid molecule encoding IPD080 polypeptides has one or more change in the nucleic acid sequence compared to the native or genomic nucleic acid sequence. In some embodiments the change in the native or genomic nucleic acid sequence includes but is not limited to: changes in the nucleic acid sequence due to the degeneracy of the genetic code; changes in the nucleic acid sequence due to the amino acid substitution, insertion, deletion and/or addition compared to the native or genomic sequence; removal of one or more intron; deletion of one or more upstream or downstream regulatory regions; and deletion of the 5' and/or 3' untranslated region associated with the genomic nucleic acid sequence. In some embodiments, the nucleic acid molecule encoding an IPD080 polypeptide is a non-genomic sequence.

A variety of polynucleotides that encode IPD080 polypeptides or related proteins are contemplated. Such polynucleotides are useful for production of IPD080 polypeptides in host cells when operably linked to a suitable promoter, transcription termination and/or polyadenylation sequences. Such polynucleotides are also useful as probes for isolating homologous or substantially homologous polynucleotides that encode IPD080 polypeptides or related proteins.

The following embodiments related to the structural model of the IPD080Aa polypeptide (SEQ ID NO: 16) are encompassed by the present disclosure:

1) An insecticidal protein comprising an amino acid sequence having at least 60% identity to SEQ ID NO: 160 and wherein the following aerolysin type three-domain structure is present:
   a) an α/β Domain I;
   b) a five-stranded anti-parallel β-sheet Domain II comprising β stands β5a, β10; β12; β6 and β9, wherein the β5a, β10, and β12 strands comprises an Arginine cluster; and c) a β-sandwich Domain III.
2) The insecticidal protein of embodiment 1, wherein the Arginine cluster comprises residues corresponding to positions 79, 196, 198, 200, 202, and 242 of SEQ ID NO: 160.
3) The insecticidal protein of embodiment 1 or 2, wherein α/β Domain I comprises a broken anti-parallel β-sheet comprising: a) three short strands β3-β2-β11 and the top portion of strand β10 at the top of the β-sheet; and b) three strands, β1-β4β10, at the bottom of the β-sheet;
4) The insecticidal protein of embodiment 3, wherein α/β Domain I further comprises three α-helices, α1, α2, α3.
5) The insecticidal protein of embodiment 1, 2, 3 or 4, wherein Domain I comprises residues corresponding to about 17 to about 76 and about 204 to about 240 of SEQ ID NO: 160.
6) The insecticidal protein of embodiment 5, wherein Domain I further comprises an aromatic amino acid cluster.
7) The insecticidal protein of embodiment 6, wherein the aromatic amino acid cluster comprises an aromatic amino acid at residues corresponding to positions 60, 64, 67, 69, 215, 222, 223, 224, and 225 of SEQ ID NO: 160.
8) The insecticidal protein of embodiment 7, wherein the aromatic amino acid cluster comprises residues corresponding to W60, Y64, Y67, W69, Y215, H222, H223, F224, and W225 of SEQ ID NO: 160.

9) The insecticidal protein of embodiment 1, 2, 3, 4, 5, 6 7 or 8, wherein Domain II further comprises: a) an amphipathic β7-β8 β-hairpin patching on one side of the β-sheet; and b) a loop between β7 and β8, wherein the loop is at least 9 amino acids in length.

10) The insecticidal protein of embodiment 9, wherein the β7-β8 β-hairpin comprises a membrane contact surface comprising mostly hydrophobic amino acids residues.

11) The insecticidal protein of embodiment 10, wherein the hydrophobic amino acids residues are at every other residue.

12) The insecticidal protein of embodiment 10 or 11, wherein the membrane contact surface comprises hydrophobic amino acids residues at positions corresponding to 128, 130, 132, 134, 136, 138, 140, 142, 144, 146, 148, 150, 152, 154, 156, and 158 of SEQ ID NO: 160.

13) The insecticidal protein of embodiment 10, 11 or 12, wherein the membrane contact surface comprises residues corresponding to H128, L130, F132, Q134, I136, Y138, I140, F142, I144, A146, G148, T150, L152, Y154, F156, and F158 of SEQ ID NO: 160.

14) The insecticidal protein of embodiment 1, 2, 3, 4, 5, 6, 7, 8, 9, 10, 11, 12 or 13, wherein the β-sandwich Domain III comprises two sheets: a) a 3-stranded sheet comprising β strands β5b, β10, and β12; and b) a 2-stranded sheet comprising β strands β6 and β9.

15) The insecticidal protein of embodiment 1, 2, 3, 4, 5, 6, 7, 8, 9, 10, 11, 12, 13 or 14 further comprising an operably linked N-terminal peptide and a C-terminal peptide.

16) The insecticidal protein of embodiment 15, wherein the N-terminal peptide comprises residues 1-16 and the C-terminal peptide comprises amino acids 264-297 of SEQ ID NO: 160.

17) The insecticidal protein of embodiment 15 or 16 further comprising a poly-Glutamic acid tail distal to the C-terminal peptide.

The following embodiments related to the structural model of the oligomeric pore of the IPD080Aa polypeptide (SEQ ID NO: 16) are encompassed by the present disclosure:

1) An oligomeric pore comprising a plurality of an insecticidal protein comprising an amino acid sequence having at least 60% identity to SEQ ID NO: 160 and wherein the following aerolysin type three-domain structure is present:
    a) an α/β Domain I;
    b) a five-stranded anti-parallel β-sheet Domain II comprising β stands β5a, β10; β12; β6 and β9, wherein the β5a, β10, and β12 strands comprises an Arginine cluster; and
    c) a β-sandwich Domain III, and where the following mushroom-like structure is present:
        i) a stem barrel forming a pore channel;
        ii) a collar;
        iii) a rivet; and
        iv) a cap.

2) The oligomeric pore of embodiment 1, wherein the oligomeric pore is a heptamer of the insecticidal protein.

3) The oligomeric pore of embodiment 1 or 2, wherein the pore channel is about 100 Å long and about 16 Å wide.

4) The oligomeric pore of embodiment 1, 2 or 3, wherein the stem barrel and collar comprises Domain III.

5) The oligomeric pore of embodiment 1, 2, 3 or 4, wherein the stem barrel and the collar form a double-layered concentric barrel comprising an inner layer and an outer layer.

6) The oligomeric pore of embodiment 5, wherein the inner layer comprises 14 anti-parallel β strands from 7 protomer β-hairpins and the outer layer comprises 21 β-strands.

7) The oligomeric pore of embodiment 1, 2, 3, 4, 5 or 6, wherein the pore channel is lined with Threonine and Serine residues.

8) The oligomeric pore of embodiment 1, 2, 3, 4, 5, 6 or 7, wherein the pore channel comprises a channel entrance comprising four negatively charged residues and two positively charged residues.

9) The oligomeric pore of embodiment 8, wherein four negatively charged residues correspond to positions 133, 147, 149, 155 of SEQ ID NO: 160, and two positively charged residues correspond to positions 135 and 137 of SEQ ID NO: 160.

10) The oligomeric pore of embodiment 28, wherein the four negatively charged residues correspond to E133, E147, E149, E155 of SEQ ID NO: 160, and two positively charged residues correspond to K135 and K137 of SEQ ID NO: 160.

11) The oligomeric pore of embodiment 1, 2, 3, 4, 5, 6, 7, 8, 9 or 10, wherein the rivet comprises the tips of the β-hairpins of the stem barrel.

12) The oligomeric pore of embodiment 1, 2, 3, 4, 5, 6, 7, 8, 9, 10 or 11, wherein the cap comprises Domain I.

Methods for Engineering IPD080 Polypeptides

Methods for engineering IPD080 polypeptides are also encompassed by the disclosure. In some embodiments, the method for engineering IPD080 polypeptides uses rational protein design based on a secondary, tertiary or quaternary structure model of the IPD080 polypeptide. In silico modeling tools are well known to one skilled in the art and can be used in the methods of the disclosure. In some embodiments, the rational protein design uses an in silico modeling tool selected from but not limited to PyMOL (PyMOL Molecular Graphics System, Version 1.7.4 Schrödinger, LLC.), Maestro©, BioLuminate (Zhu, K.; et al., Proteins, 2014, 82(8), 1646-1655; Salam, N. K et al., Protein Eng. Des. Sel., 2014, 27(10), 365-74; Beard, H. et al. PLoS ONE, 2013, 8(12), e82849), MOE© (Molecular Operating Environment (MOE), 2013.08; Chemical Computing Group Inc., 1010 Sherbooke St. West, Suite #910, Montreal, QC, Canada, H3A 2R7, 2015), Jmol, and Discovery Studio© (Accelrys Software Inc. Discovery Studio Modeling Environment, Release 3.5.0, San Diego: Accelrys Software Inc. 2013). In some embodiments, the modeling uses Discovery Studio© software. In some embodiments, the method the structural coordinates can be determined by homology modeling. In some embodiments, the method the structural coordinates can be determined by X-ray crystallography or solution NMR.

In some embodiments, the IPD080 polypeptide is engineered by the method of the disclosure to have a modified physical property compared to the native IPD080 polypeptide. In some embodiments, the modified physical properties include, but are not limited to net surface charge and charge distribution on the protein surface, net hydrophobicity and hydrophobic residue distribution on the protein surface, surface charge density, surface hydrophobicity density, total count of surface ionizable groups, and protein size. In some embodiments, the modified physical in-properties include, but are not limited to solubility, folding, stability, protease stability, digestibility, planta expression, insecticidal potency, spectrum of insecticidal activity, ion channel activity of protomer pore, and receptor binding. In some embodiments, the modified physical property is improved protease stability, improved in-planta expression, improved solubility, improved potency, improved ion-channel activity of protomer pore, and/or improved receptor binding.

Using the methods of the disclosure, proteolytically-sensitive sites can be identified and may be modified or utilized to produce more stable or more biologically active IPD080 polypeptides.

Using methods of the disclosure, sites involved in receptor binding and/or pore formation can be identified and may be modified to create IPD080 polypeptides having enhanced insecticidal activity; enhanced ability to form channels; and reduced size.

Using methods of the disclosure, occupation of a site by a water molecule can be identified and can be modified to create IPD080 molecules having modified flexibility in a region or increasing the number of hydrophobic residues along that surface, which may be involved in receptor binding and/or pore formation.

Using methods of the disclosure, hydrogen bonding in a region can be identified and the amino acids may be substituted to modify the number of hydrogen bonds, including salt bridges, to create IPD080 polypeptides having a modified hydrophobic interaction surface facilitating pre-pore and pore formation and/or modified insecticidal activity.

Using methods of the disclosure, loop regions can be identified and may be modified to create IPD080 polypeptides having modified channel or pore formation, folding, and/or receptor binding.

Using methods of the disclosure, complex electrostatic surfaces and hydrophobic or hydrophilic interactions can be identified and modified to create IPD080 polypeptides having modified receptor interaction Using methods of the disclosure, metal binding sites can be identified and modified to create IPD080 polypeptides having modified ion channel or pore activity.

Using methods of the disclosure, amino acids that may be buried or otherwise removed from the surface of the protein that hold in place the three-dimensional structure can be identified and modified to create IPD080 polypeptides having modified stability or flexibility.

Using methods of the disclosure, non-specific binding sites to other biomolecules can be identified and modified to create IPD080 polypeptides having modified receptor binding to the specific receptor and enhanced toxicity.

Applying various computational tools known to one skilled in the art, coupled with the understanding of saturated mutagenesis, and the structural/functional relationship for IPD080 polypeptides as disclosed herein, one skilled in the art can identify and modify various physical properties of IPD080 polypeptides for the better overall performance as an insecticidal protein against the desired targets. Combinatory mutagenesis at various regions can enhance specificity to the current active targets and potentially can also change activity spectrum against different targets. Such targeted combinatorial mutagenesis can be achieved with incorporation of mutagenic oligo nucleotides or generated by gene synthesis or the combination of both approaches. Mutagenesis on defined loop regions can also enhance physical properties of IPD080 polypeptides such as increasing protein stability by reducing protease degradation ability and increasing thermostability etc. In additional, combinatorial mutagenesis can be applied to the amino acid residues involved in hydrophobic interface surface. Enhancement of hydrophobic interface surface can potentially increase insecticidal activity, thermostability and other physical properties. Additional improvements can also be achieved through mutagenesis of other part of the molecule such as various beta-sheets and alpha helicies to increase stability and activity.

Polynucleotides Encoding IPD080 Polypeptides

One source of polynucleotides that encode IPD080 polypeptides or related proteins is a fern or other primitive plant species selected from but not limited to limited to *Lycopodium* species, *Huperzia* species or a *Phlegmariurus* species, which contains an IPD080 polynucleotide of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 355, SEQ ID NO: 356, SEQ ID NO: 357, SEQ ID NO: 358, SEQ ID NO: 359, SEQ ID NO: 360, SEQ ID NO: 361, SEQ ID NO: 362, SEQ ID NO: 363, SEQ ID NO: 351, SEQ ID NO: 352, SEQ ID NO: 364, SEQ ID NO: 346, SEQ ID NO: 347, SEQ ID NO: 348, SEQ ID NO: 349, SEQ ID NO: 350, SEQ ID NO: 353, SEQ ID NO: 354, and SEQ ID NO: 365 encoding an IPD080 polypeptide of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, and SEQ ID NO: 345, respectively. The polynucleotides of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 355, SEQ ID NO: 356, SEQ ID NO: 357, SEQ ID NO: 358, SEQ ID NO: 359, SEQ ID NO: 360, SEQ ID NO: 361, SEQ ID NO: 362, SEQ ID NO: 363, SEQ ID NO: 351, SEQ ID NO: 352, SEQ ID NO: 364, SEQ ID NO: 346, SEQ ID NO: 347, SEQ ID NO: 348, SEQ ID NO: 349, SEQ ID NO: 350, SEQ ID NO: 353, SEQ ID NO: 354, and SEQ ID NO: 365 can be used to express IPD080 polypeptides in recombinant bacterial hosts that include but are not limited to *Agrobacterium, Bacillus, Escherichia, Salmonella, Pseudomonas* and *Rhizobium* bacterial host cells. The polynucleotides are also useful as probes for isolating homologous or substantially homologous polynucleotides that encode IPD080 polypeptides or related proteins. Such probes can be used to identify homologous or substantially homologous polynucleotides derived from fern or other primitive plant species selected from but not limited to *Lycopodium* species, *Huperzia* species, and *Phlegmariurus* species.

In some embodiments, the nucleic acid molecule encoding the IPD080 polypeptide is derived from a species in the Genus *Lycopodium*. In some embodiments the nucleic acid molecule encoding the IPD080 polypeptide is derived from a *Lycopodium* species selected from but not limited to *Lycopodium alpinum* L., *Lycopodium annotinum* L., *Lycopodium clavatum* L., *Lycopodium complanatum* L., *Lycopodium dendroideum* Michx., *Lycopodium digitatum, Lycopodium xhabereri, Lycopodium hickeyi, Lycopodium xissleri, Lycopodium lagopus, Lycopodium obscurum* L., *Lycopodium phlegmaria* L., *Lycopodium sabinifolium, Lycopodium sitchense, Lycopodium tristachyum, Lycopodium venustulum, Lycopodium venustulum* var. *venustulum, Lycopodium venustulum* var. *verticale, Lycopodium volubile*, and *Lycopodium xzeilleri*.

In some embodiments, the nucleic acid molecule encoding the IPD080 polypeptide is derived from a species in the Genus *Huperzia*. In some embodiments the nucleic acid molecule encoding the IPD080 polypeptide is derived from a *Huperzia* species selected from but not limited to *Huperzia appressa, Huperzia arctica, Huperzia attenuata, Huperzia australiana, Huperzia balansae, Huperzia billardierei, Huperzia brassii, Huperzia campiana, Huperzia capellae, Huperzia carinata, Huperzia chinensis, Huperzia compacta, Huperzia crassa, Huperzia crispata, Huperzia cryptomeriana, Huperzia cumingii, Huperzia dacrydioides, Huperzia dalhousieana, Huperzia dichotoma, Huperzia emeiensis, Huperzia ericifolia, Huperzia eversa, Huperzia fargesii, Huperzia fordii, Huperzia funiformis, Huperzia goebellii, Huperzia haleakalae, Huperzia hamiltonii, Huperzia heteroclita, Huperzia hippuridea, Huperzia hippuris, Huperzia holstii, Huperzia horizontalis, Huperzia hunanensis, Huperzia hystrix, Huperzia lindenii, Huperzia linifolia, Huperzia lockyeri, Huperzia lucidula, Huperzia mingcheensis, Huperzia miyoshiana, Huperzia nanchuanensis, Huperzia nummulariifolia, Huperzia obtusifolia, Huperzia ophioglossoides, Huperzia petiolata, Huperzia phlegmaria, Huperzia phlegmarioides, Huperzia phyllantha, Huperzia pinifolia, Huperzia polydactyla, Huperzia prolifera, Huperzia reflexa, Huperzia rosenstockiana, Huperzia rufescens, Huperzia salvinoides, Huperzia sarmentosa, Huperzia selago, Huperzia serrata, Huperzia sieboldii, Huperzia somae, Huperzia squarrosa, Huperzia subulata, Huperzia sutchueniana, Huperzia tauri, Huperzia taxifolia, Huperzia tenuis, Huperzia tetragona, Huperzia tetrasticha, Huperzia unguiculata, Huperzia varia, Huperzia verticillata,* and *Huperzia wilsonii*.

In some embodiments, the nucleic acid molecule encoding the IPD080 polypeptide is derived from a species in the Genus *Phlegmariurus*. In some embodiments the nucleic acid molecule encoding the IPD080 polypeptide is derived from a *Phlegmariurus* species selected from but not limited to *Phlegmariurus afromontanus, Phlegmariurus aloifolius, Phlegmariurus balansae, Phlegmariurus bampsianus, Phlegmariurus banayanicus, Phlegmariurus bolanicus, Phlegmariurus brachystachys, Phlegmariurus, Phlegmariurus cancellatus, Phlegmariurus, Phlegmariurus cavifolius, Phlegmariurus coralium, Phlegmariurus creber, Phlegmariurus cryptomerinus, Phlegmariurus cunninghamioides, Phlegmariurus curiosus, Phlegmariurus dacrydioides, Phlegmariurus dalhousieanus, Phlegmariurus delbrueckii, Phlegmariurus dielsii, Phlegmariurus durus, Phlegmariurus ellenbeckii, Phlegmariurus elmeri, Phlegmariurus fargesii, Phlegmariurus filiformis, Phlegmariurus flagellaceus, Phlegmariurus foliosus, Phlegmariurus fordii, Phlegmariurus gagnepainianus, Phlegmariurus giganteus, Phlegmariurus gnidioides, Phlegmariurus goebelii, Phlegmariurus guandongensis, Phlegmariurus gunturensis, Phlegmariurus hamiltonii, Phlegmariurus harmsii, Phlegmariurus hellwigii, Phlegmariurus henryi, Phlegmariurus hillianus, Phlegmariurus holstii, Phlegmariurus horizontalis, Phlegmariurus humbertii, Phlegmariurus humbertii-henrici, Phlegmariurus jaegeri, Phlegmariurus juniperistachyus, Phlegmariurus lauterbachii, Phlegmariurus lecomteanus, Phlegmariurus ledermannii, Phlegmariurus lockyeri, Phlegmariurus longus, Phlegmariurus, Phlegmariurus macgregorii, Phlegmariurus macrostachys, Phlegmariurus mannii, Phlegmariurus marsupiiformis, Phlegmariurus megastachyus, Phlegmariurus merrillii, Phlegmariurus milbraedii, Phlegmariurus mingcheensis, Phlegmariurus minutifolius, Phlegmariurus multifarius, Phlegmariurus myrtifolius, Phlegmariurus nanus, Phlegmariurus neocaledonicus, Phlegmariurus nilagiricus, Phlegmariurus nummulariifolius, Phlegmariurus nutans, Phlegmariurus nylamensis, Phlegmariurus obtusifolius, Phlegmariurus oceanianus, Phlegmariurus oltmannsii, Phlegmariurus ophioglossoides, Phlegmariurus ovatifolius, Phlegmariurus parksii, Phlegmariurus patentissimus, Phlegmariurus pecten, Phlegmariurus perrerianus, Phlegmariurus petiolatus, Phlegmariurus phlegmaria, Phlegmariurus, Phlegmariurus phyllanthus, Phlegmariurus pichianus, Phlegmariurus proliferus, Phlegmariurus pulcherrimus, Phlegmariurus ribourtii, Phlegmariurus rubricus, Phlegmariurus rupicola, Phlegmariurus salvinioides, Phlegmariurus samoanus, Phlegmariurus shangsiensis, Phlegmariurus schlechteri, Phlegmariurus setifolius, Phlegmariurus sieboldii, Phlegmariurus sooianus, Phlegmariurus squarrosus, Phlegmariurus staudtii, Phlegmariurus strictus, Phlegmariurus sub falciformis, Phlegmariurus subulifolius, Phlegmariurus subtrifoliatus, Phlegmariurus talamauanus, Phlegmariurus terrae-guilelmii, Phlegmariurus tetrastichus, Phlegmariurus tetrastichoides, Phlegmariurus toppingii, Phlegmariurus tournayanus, Phlegmariurus trifoliatus, Phlegmariurus trigonus, Phlegmariurus ulicifolius, Phlegmariurus varius, Phlegmariurus whitfordii, Phlegmariurus xiphophyllus*, and *Phlegmariurus yandongensis.*

Polynucleotides that encode IPD080 polypeptides can also be synthesized de novo from an IPD080 polypeptide sequence. The sequence of the polynucleotide gene can be deduced from an IPD080 polypeptide sequence through use of the genetic code. Computer programs such as "BackTranslate" (GCG™ Package, Acclerys, Inc. San Diego, Calif.) can be used to convert a peptide sequence to the corresponding nucleotide sequence encoding the peptide. Examples of IPD080 polypeptide sequences that can be used to obtain corresponding nucleotide encoding sequences include, but are not limited to the IPD080 polypeptides of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, and SEQ ID NO: 345. Furthermore, synthetic IPD080 polynucleotide sequences of the disclosure can be designed so that they will be expressed in plants.

In some embodiments the nucleic acid molecule encoding an IPD080 polypeptide is a polynucleotide having the sequence set forth in SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 355, SEQ ID NO: 356, SEQ ID NO: 357, SEQ ID NO: 358, SEQ ID NO: 359, SEQ ID NO: 360, SEQ ID NO: 361, SEQ ID NO: 362, SEQ ID NO: 363, SEQ ID NO: 351, SEQ ID NO: 352, SEQ ID NO: 364, SEQ ID NO: 346, SEQ ID NO: 347, SEQ ID NO: 348, SEQ ID NO: 349, SEQ ID NO: 350, SEQ ID NO: 353, SEQ ID NO: 354 or SEQ ID NO: 365, and variants, fragments and complements thereof. "Complement" is used herein to refer to a nucleic acid sequence that is sufficiently complementary to a given nucleic acid sequence such that it can hybridize to the given nucleic acid sequence to thereby form a stable duplex. "Polynucleotide sequence variants" is used herein to refer to a nucleic acid sequence that except for the degeneracy of the genetic code encodes the same polypeptide.

In some embodiments, the nucleic acid molecule encoding the IPD080 polypeptide is a non-genomic nucleic acid sequence. As used herein a "non-genomic nucleic acid sequence" or "non-genomic nucleic acid molecule" or "non-genomic polynucleotide" refers to a nucleic acid molecule that has one or more change in the nucleic acid sequence compared to a native or genomic nucleic acid sequence. In some embodiments the change to a native or genomic nucleic acid molecule includes but is not limited to: changes in the nucleic acid sequence due to the degeneracy of the genetic code; optimization of the nucleic acid sequence for expression in plants; changes in the nucleic acid sequence to introduce at least one amino acid substitution, insertion, deletion and/or addition compared to the native or genomic sequence; removal of one or more intron associated with the genomic nucleic acid sequence; insertion of one or more heterologous introns; deletion of one or more upstream or downstream regulatory regions associated with the genomic nucleic acid sequence; insertion of one or more heterologous upstream or downstream regulatory regions; deletion of the 5' and/or 3' untranslated region associated with the genomic nucleic acid sequence; insertion of a heterologous 5' and/or 3' untranslated region; and modification of a polyadenylation site. In some embodiments, the non-genomic nucleic acid molecule is a synthetic nucleic acid sequence.

In some embodiments the nucleic acid molecule encoding an IPD080 polypeptide is a non-genomic polynucleotide having a nucleotide sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater identity, to the nucleic acid sequence of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 355, SEQ ID NO: 356, SEQ ID NO: 357, SEQ ID NO: 358, SEQ ID NO: 359, SEQ ID NO: 360, SEQ ID NO: 361, SEQ ID NO: 362, SEQ ID NO: 363, SEQ ID NO: 351, SEQ ID NO: 352, SEQ ID NO: 364, SEQ ID NO: 346, SEQ ID NO: 347, SEQ ID NO: 348, SEQ ID NO: 349, SEQ ID NO: 350, SEQ ID NO: 353, SEQ ID NO: 354 or SEQ ID NO: 365, wherein the IPD080 polypeptide has insecticidal activity.

In some embodiments the nucleic acid molecule encodes an IPD080 polypeptide comprising an amino acid sequence of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344 or SEQ ID NO: 345, having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35 or more amino acid substitutions, deletions and/or insertions compared to the native amino acid at the corresponding position of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344 or SEQ ID NO: 345.

Also provided are nucleic acid molecules that encode transcription and/or translation products that are subsequently spliced to ultimately produce functional IPD080 polypeptides. Splicing can be accomplished in vitro or in vivo, and can involve cis- or trans-splicing. The substrate for splicing can be polynucleotides (e.g., RNA transcripts) or polypeptides. An example of cis-splicing of a polynucleotide is where an intron inserted into a coding sequence is removed and the two flanking exon regions are spliced to generate an IPD080 polypeptide encoding sequence. An example of trans-splicing would be where a polynucleotide is encrypted by separating the coding sequence into two or more fragments that can be separately transcribed and then spliced to form the full-length pesticidal encoding sequence. The use of a splicing enhancer sequence, which can be introduced into a construct, can facilitate splicing either in cis or trans-splicing of polypeptides (U.S. Pat. Nos. 6,365,377 and 6,531,316). Thus, in some embodiments the polynucleotides do not directly encode a full-length IPD080 polypeptide, but rather encode a fragment or fragments of an IPD080 polypeptide. These polynucleotides can be used to express a functional IPD080 polypeptide through a mechanism involving splicing, where splicing can occur at the level of polynucleotide (e.g., intron/exon) and/or polypeptide (e.g., intein/extein). This can be useful, for example, in controlling expression of pesticidal activity, since a functional pesticidal polypeptide will only be expressed if all required fragments are expressed in an environment that permits splicing processes to generate functional product. In another example, introduction of one or more insertion sequences into a polynucleotide can facilitate recombination with a low homology polynucleotide; use of an intron or intein for the insertion sequence facilitates the removal of the intervening sequence, thereby restoring function of the encoded variant.

Nucleic acid molecules that are fragments of these nucleic acid sequences encoding IPD080 polypeptides are also encompassed by the embodiments. "Fragment" as used herein refers to a portion of the nucleic acid sequence encoding an IPD080 polypeptide. A fragment of a nucleic acid sequence may encode a biologically active portion of an IPD080 polypeptide or it may be a fragment that can be used as a hybridization probe or PCR primer using methods disclosed below. Nucleic acid molecules that are fragments of a nucleic acid sequence encoding an IPD080 polypeptide comprise at least about 150, 180, 210, 240, 270, 300, 330 or 360, contiguous nucleotides or up to the number of nucleotides present in a full-length nucleic acid sequence encoding an IPD080 polypeptide disclosed herein, depending upon the intended use. "Contiguous nucleotides" is used herein to refer to nucleotide residues that are immediately adjacent to one another. Fragments of the nucleic acid sequences of the embodiments will encode protein fragments that retain the biological activity of the IPD080 polypeptide and, hence, retain insecticidal activity. "Retains insecticidal activity" is used herein to refer to a polypeptide having at least about 10%, at least about 30%, at least about 50%, at least about 70%, 80%, 90%, 95% or higher of the insecticidal activity of the full-length IPD080Aa polypeptide (SEQ ID NO: 160). In some embodiments, the insecticidal activity is against a Lepidopteran species. In one embodiment, the insecticidal activity is against a Coleopteran species. In some embodiments, the insecticidal activity is against one or more insect pests of the corn rootworm complex: western corn rootworm, *Diabrotica virgifera*; northern corn rootworm, *D. barberi*: Southern corn rootworm or spotted cucumber beetle; *Diabrotica undecimpunctata howardi*, and the Mexican corn rootworm, *D. virgifera zeae*. In one embodiment, the insecticidal activity is against a *Diabrotica* species.

In some embodiments the IPD080 polypeptide is encoded by a nucleic acid sequence sufficiently homologous to the nucleic acid sequence of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 355, SEQ ID NO: 356, SEQ ID NO: 357, SEQ ID NO: 358, SEQ ID NO: 359, SEQ ID NO: 360, SEQ ID NO: 361, SEQ ID NO: 362, SEQ ID NO: 363, SEQ ID NO: 351, SEQ ID NO: 352, SEQ ID NO: 364, SEQ ID NO: 346, SEQ ID NO: 347, SEQ ID NO: 348, SEQ ID NO: 349, SEQ ID NO: 350, SEQ ID NO: 353, SEQ ID NO: 354 or SEQ ID NO: 365. "Sufficiently homologous" is used herein to refer to an amino acid or nucleic acid sequence that has at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence homology compared to a reference sequence using one of the alignment programs described herein using standard parameters. One of skill in the art will recognize that these values can be appropriately adjusted to determine corresponding homology of proteins encoded by two nucleic acid sequences by considering degeneracy, amino acid similarity, reading frame positioning, and the like. In some embodiments, the sequence homology is against the full-length sequence of the polynucleotide encoding an IPD080 polypeptide or against the full-length sequence of an IPD080 polypeptide.

In some embodiments the nucleic acid encodes an IPD080 polypeptide having at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344 or SEQ ID NO: 345. In some embodiments, the sequence identity is calculated using ClustalW algorithm in the ALIGNX® module of the Vector NTI® Program Suite (Invitrogen Corporation, Carlsbad, Calif.) with all default parameters. In some embodiments, the sequence identity is across the entire length of polypeptide calculated using ClustalW algorithm in the ALIGNX module of the Vector NTI Program Suite (Invitrogen Corporation, Carlsbad, Calif.) with all default parameters.

To determine the percent identity of two or more amino acid sequences or of two or more nucleic acid sequences, the sequences are aligned for optimal comparison purposes. The percent identity between the two sequences is a function of the number of identical positions shared by the sequences (i.e., percent identity=number of identical positions/total number of positions (e.g., overlapping positions)×100). In one embodiment, the two sequences are the same length. In another embodiment, the comparison is across the entirety of the reference sequence (e.g., across the entirety of SEQ ID NO: 160). The percent identity between two sequences can be determined using techniques similar to those described below, with or without allowing gaps. In calculating percent identity, typically exact matches are counted.

Another non-limiting example of a mathematical algorithm utilized for the comparison of sequences is the algorithm of Needleman and Wunsch, (1970) *J. Mol. Biol.* 48(3):443-453, used GAP Version 10 software to determine sequence identity or similarity using the following default parameters: % identity and % similarity for a nucleic acid sequence using GAP Weight of 50 and Length Weight of 3, and the nwsgapdna.cmpii scoring matrix; % identity or % similarity for an amino acid sequence using GAP weight of 8 and length weight of 2, and the BLOSUM62 scoring program. Equivalent programs may also be used. "Equivalent program" is used herein to refer to any sequence comparison program that, for any two sequences in question, generates an alignment having identical nucleotide residue matches and an identical percent sequence identity when compared to the corresponding alignment generated by GAP Version 10.

In some embodiments, the IPD080 polynucleotide encodes an IPD080 polypeptide comprising an amino acid sequence having at least about 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 160.

In some embodiments polynucleotides are provided encoding chimeric polypeptides comprising regions of at least two different IPD080 polypeptides of the disclosure.

In some embodiments polynucleotides are provided encoding chimeric polypeptides comprising regions of at least two different IPD080 polypeptides selected from SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, and SEQ ID NO: 345.

In some embodiments polynucleotides are provided encoding chimeric polypeptides comprising an N-terminal Region of a first IPD080 polypeptide of the disclosure operably fused to a C-terminal Region of a second IPD080 polypeptide of the disclosure.

In some embodiments polynucleotides are provided encoding chimeric polypeptides comprising an N-terminal Region of a first IPD080 polypeptide operably fused to a C-terminal Region of a second IPD080 polypeptide, where the IPD080 polypeptide is selected from SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, and SEQ ID NO: 345.

In some embodiments an IPD080 polynucleotide encodes the IPD080 polypeptide comprising an amino acid sequence of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, and SEQ ID NO: 345.

The embodiments also encompass nucleic acid molecules encoding IPD080 polypeptide variants. "Variants" of the IPD080 polypeptide encoding nucleic acid sequences include those sequences that encode the IPD080 polypeptides disclosed herein but that differ conservatively because of the degeneracy of the genetic code as well as those that are sufficiently identical as discussed above. Naturally occurring allelic variants can be identified with the use of well-known molecular biology techniques, such as polymerase chain reaction (PCR) and hybridization techniques as outlined below. Variant nucleic acid sequences also include synthetically derived nucleic acid sequences that have been generated, for example, by using site-directed mutagenesis but which still encode the IPD080 polypeptides disclosed as discussed below.

The present disclosure provides isolated or recombinant polynucleotides that encode any of the IPD080 polypeptides disclosed herein. Those having ordinary skill in the art will readily appreciate that due to the degeneracy of the genetic code, a multitude of nucleotide sequences encoding IPD080 polypeptides of the present disclosure exist.

The skilled artisan will further appreciate that changes can be introduced by mutation of the nucleic acid sequences thereby leading to changes in the amino acid sequence of the encoded IPD080 polypeptides, without altering the biological activity of the proteins. Thus, variant nucleic acid molecules can be created by introducing one or more nucleotide substitutions, additions and/or deletions into the corresponding nucleic acid sequence disclosed herein, such that one or more amino acid substitutions, additions or deletions are introduced into the encoded protein. Mutations can be introduced by standard techniques, such as site-directed mutagenesis and PCR-mediated mutagenesis. Such variant nucleic acid sequences are also encompassed by the present disclosure.

Alternatively, variant nucleic acid sequences can be made by introducing mutations randomly along all or part of the coding sequence, such as by saturation mutagenesis, and the resultant mutants can be screened for ability to confer pesticidal activity to identify mutants that retain activity. Following mutagenesis, the encoded protein can be expressed recombinantly, and the activity of the protein can be determined using standard assay techniques.

The polynucleotides of the disclosure and fragments thereof are optionally used as substrates for a variety of recombination and recursive recombination reactions, in addition to standard cloning methods as set forth in, e.g., Ausubel, Berger and Sambrook, i.e., to produce additional pesticidal polypeptide homologues and fragments thereof with desired properties. A variety of such reactions are known, including those developed by the inventors and their co-workers. Methods for producing a variant of any nucleic acid listed herein comprising recursively recombining such polynucleotide with a second (or more) polynucleotide, thus forming a library of variant polynucleotides are also embodiments of the disclosure, as are the libraries produced, the cells comprising the libraries and any recombinant polynucleotide produced by such methods. Additionally, such methods optionally comprise selecting a variant polynucleotide from such libraries based on pesticidal activity, as is wherein such recursive recombination is done in vitro or in vivo.

A variety of diversity generating protocols, including nucleic acid recursive recombination protocols are available and fully described in the art. The procedures can be used separately, and/or in combination to produce one or more variants of a nucleic acid or set of nucleic acids, as well as variants of encoded proteins. Individually and collectively, these procedures provide robust, widely applicable ways of generating diversified nucleic acids and sets of nucleic acids (including, e.g., nucleic acid libraries) useful, e.g., for the engineering or rapid evolution of nucleic acids, proteins, pathways, cells and/or organisms with new and/or improved characteristics.

While distinctions and classifications are made during the ensuing discussion for clarity, it will be appreciated that the techniques are often not mutually exclusive. Indeed, the various methods can be used singly or in combination, in parallel or in series, to access diverse sequence variants.

The result of any of the diversity generating procedures described herein can be the generation of one or more nucleic acids, which can be selected or screened for nucleic acids with or which confer desirable properties or that encode proteins with or which confer desirable properties. Following diversification by one or more of the methods herein or otherwise available to one of skill, any nucleic acids that are produced can be selected for a desired activity or property, e.g. pesticidal activity or, such activity at a desired pH, etc. This can include identifying any activity that can be detected, for example, in an automated or automatable format, by any of the assays in the art, see, e.g., discussion of screening of insecticidal activity, infra. A variety of related (or even unrelated) properties can be evaluated, in serial or in parallel, at the discretion of the practitioner.

Descriptions of a variety of diversity generating procedures for generating modified nucleic acid sequences, e.g., those coding for polypeptides having pesticidal activity or fragments thereof, are found in the following publications and the references cited therein: Soong, et al., (2000) *Nat Genet* 25(4):436-439; Stemmer, et al., (1999) *Tumor Targeting* 4:1-4; Ness, et al., (1999) *Nat Biotechnol* 17:893-896; Chang, et al., (1999) *Nat Biotechnol* 17:793-797; Minshull and Stemmer, (1999) *Curr Opin Chem Biol* 3:284-290; Christians, et al., (1999) *Nat Biotechnol* 17:259-264; Crameri, et al., (1998) *Nature* 391:288-291; Crameri, et al., (1997) *Nat Biotechnol* 15:436-438; Zhang, et al., (1997) *PNAS USA* 94:4504-4509; Patten, et al., (1997) *Curr Opin Biotechnol* 8:724-733; Crameri, et al., (1996) *Nat Med* 2:100-103; Crameri, et al., (1996) *Nat Biotechnol* 14:315-319; Gates, et al., (1996) *J Mol Biol* 255:373-386; Stemmer, (1996) "Sexual PCR and Assembly PCR" In: *The Encyclopedia of Molecular Biology*. VCH Publishers, New York. pp. 447-457; Crameri and Stemmer, (1995) *BioTechniques* 18:194-195; Stemmer, et al., (1995) *Gene,* 164:49-53; Stemmer, (1995) *Science* 270: 1510; Stemmer, (1995) *Bio/Technology* 13:549-553; Stemmer, (1994) *Nature* 370:389-391 and Stemmer, (1994) *PNAS USA* 91:10747-10751.

Mutational methods of generating diversity include, for example, site-directed mutagenesis (Ling, et al., (1997) *Anal Biochem* 254(2):157-178; Dale, et al., (1996) *Methods Mol Biol* 57:369-374; Smith, (1985) *Ann Rev Genet* 19:423-462; Botstein and Shortle, (1985) *Science* 229:1193-1201; Carter, (1986) *Biochem J* 237:1-7 and Kunkel, (1987) "The efficiency of oligonucleotide directed mutagenesis" in *Nucleic Acids & Molecular Biology* (Eckstein and Lilley, eds., Springer Verlag, Berlin)); mutagenesis using uracil containing templates (Kunkel, (1985) *PNAS USA* 82:488-492; Kunkel, et al., (1987) *Methods Enzymol* 154:367-382 and Bass, et al., (1988) *Science* 242:240-245); oligonucleotide-directed mutagenesis (Zoller and Smith, (1983) *Methods Enzymol* 100:468-500; Zoller and Smith, (1987) *Methods Enzymol* 154:329-350 (1987); Zoller and Smith, (1982) *Nucleic Acids Res* 10:6487-6500), phosphorothioate-modified DNA mutagenesis (Taylor, et al., (1985) *Nucl Acids Res* 13:8749-8764; Taylor, et al., (1985) *Nucl Acids Res* 13:8765-8787 (1985); Nakamaye and Eckstein, (1986) *Nucl Acids Res* 14:9679-9698; Sayers, et al., (1988) *Nucl Acids Res* 16:791-802 and Sayers, et al., (1988) *Nucl Acids Res* 16:803-814); mutagenesis using gapped duplex DNA (Kramer, et al., (1984) *Nucl Acids Res* 12:9441-9456; Kramer and Fritz, (1987) *Methods Enzymol* 154:350-367; Kramer, et al., (1988) *Nucl Acids Res* 16:7207 and Fritz, et al., (1988) *Nucl Acids Res* 16:6987-6999).

Additional suitable methods include point mismatch repair (Kramer, et al., (1984) *Cell* 38:879-887), mutagenesis using repair-deficient host strains (Carter, et al., (1985) *Nucl Acids Res* 13:4431-4443 and Carter, (1987) *Methods in Enzymol* 154:382-403), deletion mutagenesis (Eghtedarzadeh and Henikoff, (1986) *Nucl Acids Res* 14:5115), restriction-selection and restriction-purification (Wells, et al., (1986) *Phil Trans R Soc Lond A* 317:415-423), mutagenesis by total gene synthesis (Nambiar, et al., (1984) *Science* 223:1299-1301; Sakamar and Khorana, (1988) *Nucl Acids Res* 14:6361-6372; Wells, et al., (1985) *Gene* 34:315-323 and Grundstrom, et al., (1985) *Nucl Acids Res* 13:3305-3316), double-strand break repair (Mandecki, (1986) *PNAS USA,* 83:7177-7181 and Arnold, (1993) *Curr Opin Biotech* 4:450-455). Additional details on many of the above methods can be found in *Methods Enzymol* Volume 154, which also describes useful controls for trouble-shooting problems with various mutagenesis methods.

Additional details regarding various diversity generating methods can be found in the following US Patents, PCT Publications and Applications and EPO publications: U.S. Pat. Nos. 5,723,323, 5,763,192, 5,814,476, 5,817,483, 5,824,514, 5,976,862, 5,605,793, 5,811,238, 5,830,721, 5,834,252, 5,837,458, WO 1995/22625, WO 1996/33207, WO 1997/20078, WO 1997/35966, WO 1999/41402, WO 1999/41383, WO 1999/41369, WO 1999/41368, EP 752008, EP 0932670, WO 1999/23107, WO 1999/21979, WO 1998/31837, WO 1998/27230, WO 1998/27230, WO 2000/00632, WO 2000/09679, WO 1998/42832, WO 1999/29902, WO 1998/41653, WO 1998/41622, WO 1998/42727, WO 2000/18906, WO 2000/04190, WO 2000/42561, WO 2000/42559, WO 2000/42560, WO 2001/23401 and PCT/US01/06775.

The nucleotide sequences of the embodiments can also be used to isolate corresponding sequences from a fern, including but not limited to a *Lycopodium* species, *Huperzia* species, and *Phlegmariurus* species. In this manner, methods such as PCR, hybridization, and the like can be used to identify such sequences based on their sequence homology to the sequences set forth herein. Sequences that are selected based on their sequence identity to the entire sequences set forth herein or to fragments thereof are encompassed by the embodiments. Such sequences include sequences that are orthologs of the disclosed sequences. The term "orthologs" refers to genes derived from a common ancestral gene and which are found in different species as a result of speciation. Genes found in different species are considered orthologs when their nucleotide sequences and/or their encoded protein sequences share substantial identity as defined elsewhere herein. Functions of orthologs are often highly conserved among species.

In a PCR approach, oligonucleotide primers can be designed for use in PCR reactions to amplify corresponding DNA sequences from cDNA or genomic DNA extracted from any organism of interest. Methods for designing PCR primers and PCR cloning are generally known in the art and are disclosed in Sambrook, et al., (1989) *Molecular Cloning: A Laboratory Manual* (2d ed., Cold Spring Harbor Laboratory Press, Plainview, N.Y.), hereinafter "Sambrook". See also, Innis, et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York). Known methods of PCR include, but are not limited to, methods using paired primers, nested primers, single specific primers, degenerate primers, gene-specific primers, vector-specific primers, partially-mismatched primers, and the like.

To identify potential IPD080 polypeptides from fern or other primitive plants, the fern or other primitive plant cell lysates can be screened with antibodies generated against an IPD080 polypeptides and/or IPD080 polypeptides using Western blotting and/or ELISA methods. This type of assays can be performed in a high throughput fashion. Positive samples can be further analyzed by various techniques such as antibody based protein purification and identification. Methods of generating antibodies are well known in the art as discussed infra.

Alternatively, mass spectrometry based protein identification method can be used to identify homologs of IPD080 polypeptides using protocols in the literatures (Scott Patterson, (1998), 10.22, 1-24, Current Protocol in Molecular Biology published by John Wiley & Son Inc). Specifically, LC-MS/MS based protein identification method is used to associate the MS data of given cell lysate or desired molecular weight enriched samples (excised from SDS-PAGE gel of relevant molecular weight bands to IPD080 polypeptides) with sequence information of IPD080 polypeptides of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344 or SEQ ID NO: 345, and their homologs. Any match in peptide sequences indicates the potential of having the homologous proteins in the samples. Additional techniques (protein purification and molecular biology) can be used to isolate the protein and identify the sequences of the homologs.

In hybridization methods, all or part of the pesticidal nucleic acid sequence can be used to screen cDNA or genomic libraries. Methods for construction of such cDNA and genomic libraries are generally known in the art and are disclosed in Sambrook and Russell, (2001), supra. The so-called hybridization probes may be genomic DNA fragments, cDNA fragments, RNA fragments or other oligonucleotides and may be labeled with a detectable group such as 32P or any other detectable marker, such as other radio-isotopes, a fluorescent compound, an enzyme or an enzyme co-factor. Probes for hybridization can be made by labeling synthetic oligonucleotides based on the known IPD080 polypeptide-encoding nucleic acid sequence disclosed herein. Degenerate primers designed based on conserved nucleotides or amino acid residues in the nucleic acid sequence or encoded amino acid sequence can additionally be used. The probe typically comprises a region of nucleic acid sequence that hybridizes under stringent conditions to at least about 12, at least about 25, at least about 50, 75, 100, 125, 150, 175 or 200 consecutive nucleotides of nucleic acid sequence encoding an IPD080 polypeptide of the disclosure or a fragment or variant thereof. Methods for the preparation of probes for hybridization are generally known in the art and are disclosed in Sambrook and Russell, (2001), supra, herein incorporated by reference.

For example, an entire nucleic acid sequence, encoding an IPD080 polypeptide, disclosed herein or one or more portions thereof may be used as a probe capable of specifically hybridizing to corresponding nucleic acid sequences encoding IPD080 polypeptide-like sequences and messenger RNAs. To achieve specific hybridization under a variety of conditions, such probes include sequences that are unique and are preferably at least about 10 nucleotides in length or at least about 20 nucleotides in length. Such probes may be used to amplify corresponding pesticidal sequences from a chosen organism by PCR. This technique may be used to isolate additional coding sequences from a desired organism or as a diagnostic assay to determine the presence of coding sequences in an organism. Hybridization techniques include hybridization screening of plated DNA libraries (either plaques or colonies; see, for example, Sambrook, et al., (1989) Molecular Cloning: A Laboratory Manual (2d ed., Cold Spring Harbor Laboratory Press, Cold Spring Harbor, N.Y.).

Hybridization of such sequences may be carried out under stringent conditions. "Stringent conditions" or "stringent hybridization conditions" is used herein to refer to conditions under which a probe will hybridize to its target sequence to a detectably greater degree than to other sequences (e.g., at least 2-fold over background). Stringent conditions are sequence-dependent and will be different in different circumstances. By controlling the stringency of the hybridization and/or washing conditions, target sequences that are 100% complementary to the probe can be identified (homologous probing). Alternatively, stringency conditions can be adjusted to allow some mismatching in sequences so that lower degrees of similarity are detected (heterologous probing). Generally, a probe is less than about 1000 nucleotides in length, preferably less than 500 nucleotides in length Compositions Compositions comprising at least one IPD080 polypeptide or IPD080 chimeric polypeptide of the disclosure are also embraced.

Antibodies

Antibodies to an IPD080 polypeptide of the embodiments or to variants or fragments thereof are also encompassed. The antibodies of the disclosure include polyclonal and monoclonal antibodies as well as fragments thereof which retain their ability to bind to an IPD080 polypeptide found in the insect gut. An antibody, monoclonal antibody or fragment thereof is said to be capable of binding a molecule if it is capable of specifically reacting with the molecule to thereby bind the molecule to the antibody, monoclonal antibody or fragment thereof. The term "antibody" (Ab) or "monoclonal antibody" (Mab) is meant to include intact molecules as well as fragments or binding regions or domains thereof (such as, for example, Fab and F(ab).sub.2 fragments) which are capable of binding hapten. Such fragments are typically produced by proteolytic cleavage, such as papain or pepsin. Alternatively, hapten-binding fragments can be produced through the application of recombinant DNA technology or through synthetic chemistry. Methods for the preparation of the antibodies of the present disclosure are generally known in the art. For example, see, Antibodies, A Laboratory Manual, Ed Harlow and David Lane (eds.) Cold Spring Harbor Laboratory, N.Y. (1988), as well as the references cited therein. Standard reference works setting forth the general principles of immunology include: Klein, J. Immunology: The Science of Cell-Noncell Discrimination, John Wiley & Sons, N.Y. (1982); Dennett, et al., Monoclonal Antibodies, Hybridoma: A New Dimension in Biological Analyses, Plenum Press, N.Y. (1980) and Campbell, "Monoclonal Antibody Technology," In Laboratory Techniques in Biochemistry and Molecular Biology, Vol. 13, Burdon, et al., (eds.), Elsevier, Amsterdam (1984). See also, U.S. Pat. Nos. 4,196,265; 4,609,893; 4,713,325; 4,714,681; 4,716,111; 4,716,117 and 4,720,459. Antibodies against IPD080 polypeptides or antigen-binding portions thereof can be produced by a variety of techniques, including conventional monoclonal antibody methodology, for example the standard somatic cell hybridization technique of Kohler and Milstein, (1975) Nature 256:495. Other techniques for producing monoclonal antibody can also be employed such as viral or oncogenic transformation of B lymphocytes. An animal system for preparing hybridomas is a murine system. Immunization protocols and techniques for isolation of immunized splenocytes for fusion are known in the art. Fusion partners (e.g., murine myeloma cells) and fusion procedures are also known. The antibody and monoclonal antibodies of the disclosure can be prepared by utilizing an IPD080 polypeptide as antigens.

A kit for detecting the presence of an IPD080 polypeptide or detecting the presence of a nucleotide sequence encoding an IPD080 polypeptide in a sample is provided. In one embodiment, the kit provides antibody-based reagents for detecting the presence of an IPD080 polypeptide in a tissue sample. In another embodiment, the kit provides labeled nucleic acid probes useful for detecting the presence of one or more polynucleotides encoding an IPD080 polypeptide. The kit is provided along with appropriate reagents and controls for carrying out a detection method, as well as instructions for use of the kit.

Receptor Identification and Isolation

Receptors to the IPD080 polypeptide of the embodiments or to variants or fragments thereof are also encompassed. Methods for identifying receptors are well known in the art (see, Hofmann, et. al., (1988) Eur. J. Biochem. 173:85-91; Gill, et al., (1995) J. Biol. Chem. 27277-27282) can be employed to identify and isolate the receptor that recognizes the IPD080 polypeptide using the brush-border membrane vesicles from susceptible insects. In addition to the radioactive labeling method listed in the cited literatures, an IPD080 polypeptide can be labeled with fluorescent dye and other common labels such as streptavidin. Brush-border membrane vesicles (BBMV) of susceptible insects such as soybean looper and stink bugs can be prepared according to the protocols listed in the references and separated on SDS-PAGE gel and blotted on suitable membrane. Labeled IPD080 polypeptide can be incubated with blotted membrane of BBMV and labeled IPD080 polypeptide can be identified with the labeled reporters. Identification of protein band(s) that interact with the IPD080 polypeptide can be detected by N-terminal amino acid gas phase sequencing or mass spectrometry based protein identification method (Patterson, (1998) 10.22, 1-24, Current Protocol in Molecular Biology published by John Wiley & Son Inc). Once the protein is identified, the corresponding gene can be cloned from genomic DNA or cDNA library of the susceptible insects and binding affinity can be measured directly with the IPD080 polypeptide. Receptor function for insecticidal activity by the IPD080 polypeptide can be verified by accomplished by RNAi type of gene knock out method (Rajagopal, et al., (2002) J. Biol. Chem. 277:46849-46851).

Nucleotide Constructs, Expression Cassettes and Vectors

The use of the term "nucleotide constructs" herein is not intended to limit the embodiments to nucleotide constructs comprising DNA. Those of ordinary skill in the art will recognize that nucleotide constructs particularly polynucleotides and oligonucleotides composed of ribonucleotides and combinations of ribonucleotides and deoxyribonucleotides may also be employed in the methods disclosed herein. The nucleotide constructs, nucleic acids, and nucleotide sequences of the embodiments additionally encompass all complementary forms of such constructs, molecules, and sequences. Further, the nucleotide constructs, nucleotide molecules, and nucleotide sequences of the embodiments encompass all nucleotide constructs, molecules, and sequences which can be employed in the methods of the embodiments for transforming plants including, but not limited to, those comprised of deoxyribonucleotides, ribonucleotides, and combinations thereof. Such deoxyribonucleotides and ribonucleotides include both naturally occurring molecules and synthetic analogues. The nucleotide constructs, nucleic acids, and nucleotide sequences of the embodiments also encompass all forms of nucleotide constructs including, but not limited to, single-stranded forms, double-stranded forms, hairpins, stem-and-loop structures and the like.

A further embodiment relates to a transformed organism such as an organism selected from plant and insect cells, bacteria, yeast, baculovirus, protozoa, nematodes and algae. The transformed organism comprises a DNA molecule of the embodiments, an expression cassette comprising the DNA molecule or a vector comprising the expression cassette, which may be stably incorporated into the genome of the transformed organism.

The sequences of the embodiments are provided in DNA constructs for expression in the organism of interest. The construct will include 5' and 3' regulatory sequences operably linked to a sequence of the embodiments. The term "operably linked" as used herein refers to a functional linkage between a promoter and a second sequence, wherein the promoter sequence initiates and mediates transcription of the DNA sequence corresponding to the second sequence. Generally, operably linked means that the nucleic acid sequences being linked are contiguous and where necessary to join two protein coding regions in the same reading frame. The construct may additionally contain at least one additional gene to be cotransformed into the organism. Alternatively, the additional gene(s) can be provided on multiple DNA constructs.

Such a DNA construct is provided with a plurality of restriction sites for insertion of the IPD080 polypeptide gene sequence of the disclosure to be under the transcriptional regulation of the regulatory regions. The DNA construct may additionally contain selectable marker genes.

The DNA construct will generally include in the 5' to 3' direction of transcription: a transcriptional and translational initiation region (i.e., a promoter), a DNA sequence of the embodiments, and a transcriptional and translational termination region (i.e., termination region) functional in the organism serving as a host. The transcriptional initiation region (i.e., the promoter) may be native, analogous, foreign or heterologous to the host organism and/or to the sequence of the embodiments. Additionally, the promoter may be the natural sequence or alternatively a synthetic sequence. The term "foreign" as used herein indicates that the promoter is not found in the native organism into which the promoter is introduced. Where the promoter is "foreign" or "heterologous" to the sequence of the embodiments, it is intended that the promoter is not the native or naturally occurring promoter for the operably linked sequence of the embodiments. As used herein, a chimeric gene comprises a coding sequence operably linked to a transcription initiation region that is heterologous to the coding sequence. Where the promoter is a native or natural sequence, the expression of the operably linked sequence is altered from the wild-type expression, which results in an alteration in phenotype.

In some embodiments, the DNA construct comprises a polynucleotide encoding an IPD080 polypeptide of the embodiments.

In some embodiments, the DNA construct comprises a polynucleotide encoding a chimeric IPD080 polypeptide of the embodiments.

In some embodiments, the DNA construct comprises a polynucleotide encoding a fusion protein comprising an IPD080 polypeptide of the embodiments.

In some embodiments, the DNA construct comprises a polynucleotide comprising a first coding sequence encoding the N-terminal Region of a first IPD080 polypeptide of the disclosure and a second coding sequence encoding the C-terminal Region of a second IPD080 polypeptide of the disclosure.

In some embodiments, the DNA construct may also include a transcriptional enhancer sequence. As used herein, the term an "enhancer" refers to a DNA sequence which can stimulate promoter activity, and may be an innate element of the promoter or a heterologous element inserted to enhance the level or tissue-specificity of a promoter. Various enhancers are known in the art including for example, introns with gene expression enhancing properties in plants (US Patent Application Publication Number 2009/0144863, the ubiquitin intron (i.e., the maize ubiquitin intron 1 (see, for example, NCBI sequence S94464)), the omega enhancer or the omega prime enhancer (Gallie, et al., (1989) *Molecular Biology of RNA* ed. Cech (Liss, New York) 237-256 and Gallie, et al., (1987) *Gene* 60:217-25), the CaMV 35S enhancer (see, e.g., Benfey, et al., (1990) *EMBO J.* 9:1685-96) and the enhancers of U.S. Pat. No. 7,803,992 may also be used, each of which is incorporated by reference. The above list of transcriptional enhancers is not meant to be limiting. Any appropriate transcriptional enhancer can be used in the embodiments.

The termination region may be native with the transcriptional initiation region, may be native with the operably linked DNA sequence of interest, may be native with the plant host or may be derived from another source (i.e., foreign or heterologous to the promoter, the sequence of interest, the plant host or any combination thereof).

Convenient termination regions are available from the Ti-plasmid of *A. tumefaciens*, such as the octopine synthase and nopaline synthase termination regions. See also, Guerineau, et al., (1991) *Mol. Gen. Genet.* 262:141-144; Proudfoot, (1991) *Cell* 64:671-674; Sanfacon, et al., (1991) *Genes Dev.* 5:141-149; Mogen, et al., (1990) *Plant Cell* 2:1261-1272; Munroe, et al., (1990) *Gene* 91:151-158; Ballas, et al., (1989) *Nucleic Acids Res.* 17:7891-7903 and Joshi, et al., (1987) *Nucleic Acid Res.* 15:9627-9639.

Where appropriate, a nucleic acid may be optimized for increased expression in the host organism. Thus, where the host organism is a plant, the synthetic nucleic acids can be synthesized using plant-preferred codons for improved expression. See, for example, Campbell and Gowri, (1990) *Plant Physiol.* 92:1-11 for a discussion of host-preferred usage. For example, although nucleic acid sequences of the embodiments may be expressed in both monocotyledonous and dicotyledonous plant species, sequences can be modified to account for the specific preferences and GC content preferences of monocotyledons or dicotyledons as these preferences have been shown to differ (Murray et al. (1989) *Nucleic Acids Res.* 17:477-498). Thus, the maize-preferred codon for a particular amino acid may be derived from known gene sequences from maize. Maize usage for 28 genes from maize plants is listed in Table 4 of Murray, et al., supra. Methods are available in the art for synthesizing plant-preferred genes. See, for example, Murray, et al., (1989) *Nucleic Acids Res.* 17:477-498, and Liu H et al. *Mol Bio Rep* 37:677-684, 2010, herein incorporated by reference. A *Zea* maize usage table can be also found at kazusa.or.jp//cgi-bin/show.cgi?species=4577, which can be accessed using the www prefix.

A *Glycine max* usage table can be found at kazusa.or.jp//cgi-bin/show.cgi?species=3847&aa=1&style=N, which can be accessed using the www prefix.

In some embodiments, the recombinant nucleic acid molecule encoding an IPD080 polypeptide has maize optimized codons.

Additional sequence modifications are known to enhance gene expression in a cellular host. These include elimination of sequences encoding spurious polyadenylation signals, exon-intron splice site signals, transposon-like repeats, and other well-characterized sequences that may be deleterious to gene expression. The GC content of the sequence may be adjusted to levels average for a given cellular host, as calculated by reference to known genes expressed in the host cell. The term "host cell" as used herein refers to a cell which contains a vector and supports the replication and/or expression of the expression vector is intended. Host cells may be prokaryotic cells such as *E. coli* or eukaryotic cells such as yeast, insect, amphibian or mammalian cells or monocotyledonous or dicotyledonous plant cells. An example of a monocotyledonous host cell is a maize host cell. When possible, the sequence is modified to avoid predicted hairpin secondary mRNA structures.

The expression cassettes may additionally contain 5' leader sequences. Such leader sequences can act to enhance translation. Translation leaders are known in the art and include: picornavirus leaders, for example, EMCV leader (Encephalomyocarditis 5' noncoding region) (Elroy-Stein, et al., (1989) *Proc. Natl. Acad. Sci. USA* 86:6126-6130); potyvirus leaders, for example, TEV leader (Tobacco Etch Virus) (Gallie, et al., (1995) *Gene* 165(2):233-238), MDMV leader (Maize Dwarf Mosaic Virus), human immunoglobulin heavy-chain binding protein (BiP) (Macejak, et al., (1991) *Nature* 353:90-94); untranslated leader from the coat protein mRNA of alfalfa mosaic virus (AMV RNA 4) (Jobling, et al., (1987) *Nature* 325:622-625); tobacco mosaic virus leader (TMV) (Gallie, et al., (1989) in *Molecular Biology of RNA*, ed. Cech (Liss, New York), pp. 237-256) and maize chlorotic mottle virus leader (MCMV) (Lommel, et al., (1991) *Virology* 81:382-385). See also, Della-Cioppa, et al., (1987) *Plant Physiol.* 84:965-968. Such constructs may also contain a "signal sequence" or "leader sequence" to facilitate cotranslational or post-translational transport of the peptide to certain intracellular structures such as the chloroplast (or other plastid), endoplasmic reticulum or Golgi apparatus.

"Signal sequence" as used herein refers to a sequence that is known or suspected to result in cotranslational or post-translational peptide transport across the cell membrane. In eukaryotes, this typically involves secretion into the Golgi apparatus, with some resulting glycosylation. Insecticidal toxins of bacteria are often synthesized as protoxins, which are proteolytically activated in the gut of the target pest (Chang, (1987) *Methods Enzymol.* 153:507-516). In some embodiments, the signal sequence is in the native sequence or may be derived from a sequence of the embodiments. "Leader sequence" as used herein refers to any sequence that when translated, results in an amino acid sequence sufficient to trigger cotranslational transport of the peptide chain to a subcellular organelle. Thus, this includes leader sequences targeting transport and/or glycosylation by passage into the endoplasmic reticulum, passage to vacuoles, plastids including chloroplasts, mitochondria, and the like. Nuclear-encoded proteins targeted to the chloroplast thylakoid lumen compartment have a characteristic bipartite transit peptide, composed of a stromal targeting signal peptide and a lumen targeting signal peptide. The stromal targeting information is in the amino-proximal portion of the transit peptide. The lumen targeting signal peptide is in the carboxyl-proximal portion of the transit peptide, and contains all the information for targeting to the lumen. Recent research in proteomics of the higher plant chloroplast has achieved in the identification of numerous nuclear-encoded lumen proteins (Kieselbach et al. *FEBS LETT* 480:271-276, 2000; Peltier et al. Plant Cell 12:319-341, 2000; Bricker et al. *Biochim. Biophys Acta* 1503:350-356, 2001), the lumen targeting signal peptide of which can potentially be used in accordance with the present disclosure. About 80 proteins from *Arabidopsis*, as well as homologous proteins from spinach and garden pea, are reported by Kieselbach et al., *Photosynthesis Research*, 78:249-264, 2003. Table 2 of this publication, which is incorporated into the description herewith by reference, discloses 85 proteins from the chloroplast lumen, identified by their accession number (see also US Patent Application Publication 2009/09044298). In addition, the recently published draft version of the rice genome (Goff et al, *Science* 296:92-100, 2002) is a suitable source for lumen targeting signal peptide which may be used in accordance with the present disclosure.

Suitable chloroplast transit peptides (CTP) are well known to one skilled in the art also include chimeric CT's comprising but not limited to, an N-terminal domain, a central domain or a C-terminal domain from a CTP from *Oryza sativa* 1-decoy-D xylose-5-Phosphate Synthase *Oryza sativa*-Superoxide dismutase *Oryza sativa*-soluble starch synthase *Oryza sativa*-NADP-dependent Malic acid enzyme *Oryza sativa*-Phospho-2-dehydro-3-deoxyheptonate Aldolase 2 *Oryza sativa*-L-Ascorbate peroxidase 5 *Oryza sativa*-Phosphoglucan water dikinase, *Zea Mays* ssRUBISCO, *Zea Mays*-beta-glucosidase, *Zea Mays*-Malate dehydrogenase, *Zea Mays* Thioredoxin M-type US Patent Application Publication 2012/0304336).

The IPD080 polypeptide gene to be targeted to the chloroplast may be optimized for expression in the chloroplast to account for differences in usage between the plant nucleus and this organelle. In this manner, the nucleic acids of interest may be synthesized using chloroplast-preferred sequences.

In preparing the expression cassette, the various DNA fragments may be manipulated to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites or the like. For this purpose, in vitro mutagenesis, primer repair, restriction, annealing, resubstitutions, e.g., transitions and transversions, may be involved.

Several promoters can be used in the practice of the embodiments. The promoters can be selected based on the desired outcome. The nucleic acids can be combined with constitutive, tissue-preferred, inducible or other promoters for expression in the host organism. Suitable constitutive promoters for use in a plant host cell include, for example, the core promoter of the Rsyn7 promoter and other constitutive promoters disclosed in WO 1999/43838 and U.S. Pat. No. 6,072,050; the core CaMV 35S promoter (Odell, et al., (1985) *Nature* 313:810-812); rice actin (McElroy, et al., (1990) *Plant Cell* 2:163-171); ubiquitin (Christensen, et al., (1989) *Plant Mol. Biol.* 12:619-632 and Christensen, et al., (1992) *Plant Mol. Biol.* 18:675-689); pEMU (Last, et al., (1991) *Theor. Appl. Genet.* 81:581-588); MAS (Velten, et al., (1984) *EMBO J.* 3:2723-2730); ALS promoter (U.S. Pat. No. 5,659,026) and the like. Other constitutive promoters include, for example, those discussed in U.S. Pat. Nos. 5,608,149; 5,608,144; 5,604,121; 5,569,597; 5,466,785; 5,399,680; 5,268,463; 5,608,142 and 6,177,611.

Depending on the desired outcome, it may be beneficial to express the gene from an inducible promoter. Of particular interest for regulating the expression of the nucleotide sequences of the embodiments in plants are wound-inducible promoters. Such wound-inducible promoters, may respond to damage caused by insect feeding, and include potato proteinase inhibitor (pin II) gene (Ryan, (1990) *Ann. Rev. Phytopath.* 28:425-449; Duan, et al., (1996) *Nature Biotechnology* 14:494-498); wun1 and wun2, U.S. Pat. No. 5,428,148; win1 and win2 (Stanford, et al., (1989) *Mol. Gen. Genet.* 215:200-208); systemin (McGurl, et al., (1992) *Science* 225:1570-1573); WIP1 (Rohmeier, et al., (1993) *Plant Mol. Biol.* 22:783-792; Eckelkamp, et al., (1993) *FEBS Letters* 323:73-76); MPI gene (Corderok, et al., (1994) *Plant J.* 6(2):141-150) and the like, herein incorporated by reference.

Additionally, pathogen-inducible promoters may be employed in the methods and nucleotide constructs of the embodiments. Such pathogen-inducible promoters include those from pathogenesis-related proteins (PR proteins), which are induced following infection by a pathogen; e.g., PR proteins, SAR proteins, beta-1,3-glucanase, chitinase, etc. See, for example, Redolfi, et al., (1983) *Neth. J. Plant Pathol.* 89:245-254; Uknes, et al., (1992) *Plant Cell* 4: 645-656 and Van Loon, (1985) *Plant Mol. Virol.* 4:111-116. See also, WO 1999/43819, herein incorporated by reference.

Of interest are promoters that are expressed locally at or near the site of pathogen infection. See, for example, Marineau, et al., (1987) *Plant Mol. Biol.* 9:335-342; Matton, et al., (1989) *Molecular Plant-Microbe Interactions* 2:325-331; Somsisch, et al., (1986) *Proc. Natl. Acad. Sci. USA* 83:2427-2430; Somsisch, et al., (1988) *Mol. Gen. Genet.* 2:93-98 and Yang, (1996) *Proc. Natl. Acad. Sci. USA* 93:14972-14977. See also, Chen, et al., (1996) *Plant J.* 10:955-966; Zhang, et al., (1994) *Proc. Natl. Acad. Sci. USA* 91:2507-2511; Warner, et al., (1993) *Plant J.* 3:191-201; Siebertz, et al., (1989) *Plant Cell* 1:961-968; U.S. Pat. No. 5,750,386 (nematode-inducible) and the references cited therein. Of particular interest is the inducible promoter for the maize PRms gene, whose expression is induced by the pathogen *Fusarium moniliforme* (see, for example, Cordero, et al., (1992) *Physiol. Mol. Plant Path.* 41:189-200).

Chemical-regulated promoters can be used to modulate the expression of a gene in a plant through the application of an exogenous chemical regulator. Depending upon the objective, the promoter may be a chemical-inducible promoter, where application of the chemical induces gene expression or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1a promoter, which is activated by salicylic acid. Other chemical-regulated promoters of interest include steroid-responsive promoters (see, for example, the glucocorticoid-inducible promoter in Schena, et al., (1991) *Proc. Natl. Acad. Sci. USA* 88:10421-10425 and McNellis, et al., (1998) *Plant J.* 14(2):247-257) and tetracycline-inducible and tetracycline-repressible promoters (see, for example, Gatz, et al., (1991) *Mol. Gen. Genet.* 227:229-237 and U.S. Pat. Nos. 5,814,618 and 5,789,156), herein incorporated by reference.

Tissue-preferred promoters can be utilized to target enhanced an IPD080 polypeptide expression within a particular plant tissue. Tissue-preferred promoters include those discussed in Yamamoto, et al., (1997) *Plant J.* 12(2)255-265; Kawamata, et al., (1997) *Plant Cell Physiol.* 38(7): 792-803; Hansen, et al., (1997) *Mol. Gen Genet.* 254(3): 337-343; Russell, et al., (1997) *Transgenic Res.* 6(2):157-168; Rinehart, et al., (1996) *Plant Physiol.* 112(3):1331-1341; Van Camp, et al., (1996) *Plant Physiol.* 112(2):525-535; Canevascini, et al., (1996) *Plant Physiol.* 112(2):513-524; Yamamoto, et al., (1994) *Plant Cell Physiol.* 35(5): 773-778; Lam, (1994) *Results Probl. Cell Differ.* 20:181-196; Orozco, et al., (1993) *Plant Mol Biol.* 23(6):1129-1138; Matsuoka, et al., (1993) *Proc Natl. Acad. Sci. USA* 90(20): 9586-9590 and Guevara-Garcia, et al., (1993) *Plant J.* 4(3):495-505. Such promoters can be modified, if necessary, for weak expression.

Leaf-preferred promoters are known in the art. See, for example, Yamamoto, et al., (1997) *Plant J.* 12(2):255-265; Kwon, et al., (1994) *Plant Physiol.* 105:357-67; Yamamoto, et al., (1994) *Plant Cell Physiol.* 35(5):773-778; Gotor, et al., (1993) *Plant J.* 3:509-18; Orozco, et al., (1993) *Plant Mol. Biol.* 23(6):1129-1138 and Matsuoka, et al., (1993) *Proc. Natl. Acad. Sci. USA* 90(20):9586-9590.

Root-preferred or root-specific promoters are known and can be selected from the many available from the literature or isolated de novo from various compatible species. See, for example, Hire, et al., (1992) *Plant Mol. Biol.* 20(2):207-218 (soybean root-specific glutamine synthetase gene); Keller and Baumgartner, (1991) *Plant Cell* 3(10):1051-1061 (root-specific control element in the GRP 1.8 gene of French bean); Sanger, et al, (1990) *Plant Mol. Biol.* 14(3):433-443 (root-specific promoter of the mannopine synthase (MAS) gene of *Agrobacterium tumefaciens*) and Miao, et al., (1991) *Plant Cell* 3(1):11-22 (full-length cDNA clone encoding cytosolic glutamine synthetase (GS), which is expressed in roots and root nodules of soybean). See also, Bogusz, et al, (1990) *Plant Cell* 2(7):633-641, where two root-specific promoters isolated from hemoglobin genes from the nitrogen-fixing nonlegume *Parasponia andersonii* and the related non-nitrogen-fixing nonlegume *Trema tomentosa* are described. The promoters of these genes were linked to a 3-glucuronidase reporter gene and introduced into both the nonlegume *Nicotiana tabacum* and the legume *Lotus corniculatus*, and in both instances root-specific promoter activity was preserved. Leach and Aoyagi, (1991) describe their analysis of the promoters of the highly expressed rolC and rolD root-inducing genes of *Agrobacterium rhizogenes* (see, *Plant Science* (Limerick) 79(1):69-76). They concluded that enhancer and tissue-preferred DNA determinants are dissociated in those promoters. Teeri, et al., (1989) used gene fusion to lacZ to show that the *Agrobacterium* T-DNA gene encoding octopine synthase is especially active in the epidermis of the root tip and that the TR2' gene is root specific in the intact plant and stimulated by wounding in leaf tissue, an especially desirable combination of characteristics for use with an insecticidal or larvicidal gene (see, *EMBO J.* 8(2): 343-350). The TR1' gene fused to nptII (neomycin phosphotransferase II) showed similar characteristics. Additional root-preferred promoters include the VfENOD-GRP3 gene promoter (Kuster, et al., (1995) *Plant Mol. Biol.* 29(4):759-772) and rolB promoter (Capana, et al., (1994) *Plant Mol. Biol.* 25(4):681-691. See also, U.S. Pat. Nos. 5,837,876; 5,750,386; 5,633,363; 5,459,252; 5,401,836; 5,110,732 and 5,023,179. *Arabidopsis thaliana* root-preferred regulatory sequences are disclosed in US20130117883.

"Seed-preferred" promoters include both "seed-specific" promoters (those promoters active during seed development such as promoters of seed storage proteins) as well as "seed-germinating" promoters (those promoters active during seed germination). See, Thompson, et al., (1989) *BioEssays* 10:108, herein incorporated by reference. Such seed-preferred promoters include, but are not limited to, Cim1 (cytokinin-induced message); cZ19B1 (maize 19 kDa zein); and milps (myo-inositol-1-phosphate synthase) (see, U.S. Pat. No. 6,225,529, herein incorporated by reference). Gamma-zein and Glb-1 are endosperm-specific promoters. For dicots, seed-specific promoters include, but are not limited to, Kunitz trypsin inhibitor 3 (KTi3) (Jofuku and Goldberg, (1989) *Plant Cell* 1:1079-1093), bean β-phaseolin, napin, β-conglycinin, glycinin 1, soybean lectin, cruciferin, and the like. For monocots, seed-specific promoters include, but are not limited to, maize 15 kDa zein, 22 kDa zein, 27 kDa zein, g-zein, waxy, shrunken 1, shrunken 2, globulin 1, etc. See also, WO 2000/12733, where seed-preferred promoters from end1 and end2 genes are disclosed; herein incorporated by reference. In dicots, seed specific promoters include but are not limited to seed coat promoter from *Arabidopsis*, pBAN; and the early seed promoters from *Arabidopsis, p26, p63*, and p63tr (U.S. Pat. Nos. 7,294,760 and 7,847,153). A promoter that has "preferred" expression in a particular tissue is expressed in that tissue to a greater degree than in at least one other plant tissue. Some tissue-preferred promoters show expression almost exclusively in the particular tissue.

Where low level expression is desired, weak promoters will be used. Generally, the term "weak promoter" as used herein refers to a promoter that drives expression of a coding sequence at a low level. By low level expression at levels of between about 1/1000 transcripts to about 1/100,000 transcripts to about 1/500,000 transcripts is intended. Alternatively, it is recognized that the term "weak promoters" also encompasses promoters that drive expression in only a few cells and not in others to give a total low level of expression. Where a promoter drives expression at unacceptably high levels, portions of the promoter sequence can be deleted or modified to decrease expression levels.

Such weak constitutive promoters include, for example the core promoter of the Rsyn7 promoter (WO 1999/43838 and U.S. Pat. No. 6,072,050), the core 35S CaMV promoter, and the like. Other constitutive promoters include, for example, those disclosed in U.S. Pat. Nos. 5,608,149; 5,608,144; 5,604,121; 5,569,597; 5,466,785; 5,399,680; 5,268,463; 5,608,142 and 6,177,611, herein incorporated by reference.

The above list of promoters is not meant to be limiting. Any appropriate promoter can be used in the embodiments.

Generally, the expression cassette will comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones and 2,4-dichlorophenoxyacetate (2,4-D). Additional examples of suitable selectable marker genes include, but are not limited to, genes encoding resistance to chloramphenicol (Herrera Estrella, et al., (1983) *EMBO J.* 2:987-992); methotrexate (Herrera Estrella, et al., (1983) *Nature* 303:209-213 and Meijer, et al., (1991) *Plant Mol. Biol.* 16:807-820); streptomycin (Jones, et al., (1987) *Mol. Gen. Genet.* 210:86-91); spectinomycin (Bretagne-Sagnard, et al., (1996) *Transgenic Res.* 5:131-137); bleomycin (Hille, et al., (1990) *Plant Mol. Biol.* 7:171-176); sulfonamide (Guerineau, et al., (1990) *Plant Mol. Biol.* 15:127-136); bromoxynil (Stalker, et al., (1988) *Science* 242:419-423); glyphosate (Shaw, et al, (1986) *Science* 233:478-481 and U.S. patent application Ser. Nos. 10/004,357 and 10/427,692); phosphinothricin (DeBlock, et al, (1987) *EMBO J.* 6:2513-2518). See generally, Yarranton, (1992) *Curr. Opin. Biotech.* 3:506-511; Christopherson, et al., (1992) *Proc. Natl. Acad. Sci. USA* 89:6314-6318; Yao, et al., (1992) *Cell* 71:63-72; Reznikoff, (1992) *Mol. Microbiol* 6:2419-2422; Barkley, et al, (1980) in *The Operon*, pp. 177-220; Hu, et al, (1987) *Cell* 48:555-566; Brown, et al., (1987) *Cell* 49:603-612; Figge, et al., (1988) *Cell* 52:713-722; Deuschle, et al., (1989) *Proc. Natl. Acad. Sci. USA* 86:5400-5404; Fuerst, et al., (1989) *Proc. Natl. Acad. Sci. USA* 86:2549-2553; Deuschle, et al., (1990) *Science* 248:480-483; Gossen, (1993) Ph.D. Thesis, University of Heidelberg; Reines, et al, (1993) *Proc. Natl. Acad. Sci. USA* 90:1917-1921; Labow, et al., (1990) *Mol. Cell. Biol.* 10:3343-3356; Zambretti, et al., (1992) *Proc. Natl. Acad. Sci. USA* 89:3952-3956; Baim, et al., (1991) *Proc. Natl. Acad. Sci. USA* 88:5072-5076; Wyborski, et al., (1991) *Nucleic Acids Res.* 19:4647-4653; Hillenand-Wissman, (1989) *Topics Mol. Struc. Biol.* 10:143-162; Degenkolb, et al., (1991) *Antimicrob. Agents Chemother.* 35:1591-1595; Kleinschnidt, et al., (1988) *Biochemistry* 27:1094-1104; Bonin, (1993) Ph.D. Thesis, University of Heidelberg; Gossen, et al., (1992) *Proc. Natl. Acad. Sci. USA* 89:5547-5551; Oliva, et al., (1992) *Antimicrob. Agents Chemother.* 36:913-919; Hlavka, et al., (1985) *Handbook of Experimental Pharmacology*, Vol. 78 (Springer-Verlag, Berlin) and Gill, et al., (1988) *Nature* 334:721-724. Such disclosures are herein incorporated by reference.

The above list of selectable marker genes is not meant to be limiting. Any selectable marker gene can be used in the embodiments.

Plant Transformation

The methods of the embodiments involve introducing a polypeptide or polynucleotide into a plant. "Introducing" is as used herein means presenting to the plant the polynucleotide or polypeptide in such a manner that the sequence gains access to the interior of a cell of the plant. The methods of the embodiments do not depend on a particular method for introducing a polynucleotide or polypeptide into a plant, only that the polynucleotide or polypeptides gains access to the interior of at least one cell of the plant. Methods for introducing polynucleotide or polypeptides into plants are known in the art including, but not limited to, stable transformation methods, transient transformation methods, and virus-mediated methods.

"Stable transformation" is as used herein means that the nucleotide construct introduced into a plant integrates into the genome of the plant and is capable of being inherited by the progeny thereof. "Transient transformation" as used herein means that a polynucleotide is introduced into the plant and does not integrate into the genome of the plant or a polypeptide is introduced into a plant. "Plant" as used herein refers to whole plants, plant organs (e.g., leaves, stems, roots, etc.), seeds, plant cells, propagules, embryos and progeny of the same. Plant cells can be differentiated or undifferentiated (e.g. callus, suspension culture cells, protoplasts, leaf cells, root cells, phloem cells and pollen).

Transformation protocols as well as protocols for introducing nucleotide sequences into plants may vary depending on the type of plant or plant cell, i.e., monocot or dicot, targeted for transformation. Suitable methods of introducing nucleotide sequences into plant cells and subsequent insertion into the plant genome include microinjection (Crossway, et al., (1986) *Biotechniques* 4:320-334), electroporation (Riggs, et al., (1986) *Proc. Natl. Acad. Sci. USA* 83:5602-5606), *Agrobacterium*-mediated transformation (U.S. Pat. Nos. 5,563,055 and 5,981,840), direct gene transfer (Paszkowski, et al., (1984) *EMBO J.* 3:2717-2722) and ballistic particle acceleration (see, for example, U.S. Pat. Nos. 4,945,050; 5,879,918; 5,886,244 and 5,932,782; Tomes, et al., (1995) in *Plant Cell, Tissue, and Organ Culture: Fundamental Methods*, ed. Gamborg and Phillips, (Springer-Verlag, Berlin) and McCabe, et al., (1988) *Bio/technology* 6:923-926) and Lec1 transformation (WO 00/28058). For potato transformation see, Tu, et al., (1998) *Plant Molecular Biology* 37:829-838 and Chong, et al., (2000) *Transgenic Research* 9:71-78. Additional transformation procedures can be found in Weissinger, et al., (1988) *Ann. Rev. Genet.* 22:421-477; Sanford, et al., (1987) *Particulate Science and Technology* 5:27-37 (onion); Christou, et al., (1988) *Plant Physiol.* 87:671-674 (soybean); McCabe, et al., (1988) *Bio/Technology* 6:923-926 (soybean); Finer and McMullen, (1991) *In Vitro Cell Dev. Biol.* 27P:175-182 (soybean); Singh, et al., (1998) *Theor. Appl. Genet.* 96:319-324 (soybean); Datta, et al., (1990) *Biotechnology* 8:736-740 (rice); Klein, et al., (1988) *Proc. Natl. Acad. Sci. USA*

85:4305-4309 (maize); Klein, et al., (1988) *Biotechnology* 6:559-563 (maize); U.S. Pat. Nos. 5,240,855; 5,322,783 and 5,324,646; Klein, et al., (1988) *Plant Physiol.* 91:440-444 (maize); Fromm, et al., (1990) *Biotechnology* 8:833-839 (maize); Hooykaas-Van Slogteren, et al., (1984) *Nature* (London) 311:763-764; U.S. Pat. No. 5,736,369 (cereals); Bytebier, et al., (1987) *Proc. Natl. Acad. Sci. USA* 84:5345-5349 (Liliaceae); De Wet, et al., (1985) in *The Experimental Manipulation of Ovule Tissues*, ed. Chapman, et al., (Longman, New York), pp. 197-209 (pollen); Kaeppler, et al, (1990) *Plant Cell Reports* 9:415-418 and Kaeppler, et al., (1992) *Theor. Appl. Genet.* 84:560-566 (whisker-mediated transformation); D'Halluin, et al., (1992) *Plant Cell* 4:1495-1505 (electroporation); Li, et al., (1993) *Plant Cell Reports* 12:250-255 and Christou and Ford, (1995) *Annals of Botany* 75:407-413 (rice); Osjoda, et al., (1996) *Nature Biotechnology* 14:745-750 (maize via *Agrobacterium tumefaciens*); all of which are herein incorporated by reference.

In specific embodiments, the sequences of the embodiments can be provided to a plant using a variety of transient transformation methods. Such transient transformation methods include, but are not limited to, the introduction of the IPD080 polynucleotide or variants and fragments thereof directly into the plant or the introduction of the IPD080 polypeptide transcript into the plant. Such methods include, for example, microinjection or particle bombardment. See, for example, Crossway, et al., (1986) *Mol Gen. Genet.* 202:179-185; Nomura, et al., (1986) *Plant Sci.* 44:53-58; Hepler, et al., (1994) *Proc. Natl. Acad. Sci.* 91:2176-2180 and Hush, et al., (1994) *The Journal of Cell Science* 107: 775-784, all of which are herein incorporated by reference. Alternatively, the IPD080 polynucleotide can be transiently transformed into the plant using techniques known in the art. Such techniques include viral vector system and the precipitation of the polynucleotide in a manner that precludes subsequent release of the DNA. Thus, transcription from the particle-bound DNA can occur, but the frequency with which it is released to become integrated into the genome is greatly reduced. Such methods include the use of particles coated with polyethylimine (PEI; Sigma #P3143).

Methods are known in the art for the targeted insertion of a polynucleotide at a specific location in the plant genome. In one embodiment, the insertion of the polynucleotide at a desired genomic location is achieved using a site-specific recombination system. See, for example, WO 1999/25821, WO 1999/25854, WO 1999/25840, WO 1999/25855 and WO 1999/25853, all of which are herein incorporated by reference. Briefly, the polynucleotide of the embodiments can be contained in transfer cassette flanked by two non-identical recombination sites. The transfer cassette is introduced into a plant have stably incorporated into its genome a target site which is flanked by two non-identical recombination sites that correspond to the sites of the transfer cassette. An appropriate recombinase is provided and the transfer cassette is integrated at the target site. The polynucleotide of interest is thereby integrated at a specific chromosomal position in the plant genome.

Plant transformation vectors may be comprised of one or more DNA vectors needed for achieving plant transformation. For example, it is a common practice in the art to utilize plant transformation vectors that are comprised of more than one contiguous DNA segment. These vectors are often referred to in the art as "binary vectors". Binary vectors as well as vectors with helper plasmids are most often used for *Agrobacterium*-mediated transformation, where the size and complexity of DNA segments needed to achieve efficient transformation is quite large, and it is advantageous to separate functions onto separate DNA molecules. Binary vectors typically contain a plasmid vector that contains the cis-acting sequences required for T-DNA transfer (such as left border and right border), a selectable marker that is engineered to be capable of expression in a plant cell, and a "gene of interest" (a gene engineered to be capable of expression in a plant cell for which generation of transgenic plants is desired). Also present on this plasmid vector are sequences required for bacterial replication. The cis-acting sequences are arranged in a fashion to allow efficient transfer into plant cells and expression therein. For example, the selectable marker gene and the pesticidal gene are located between the left and right borders. Often a second plasmid vector contains the trans-acting factors that mediate T-DNA transfer from *Agrobacterium* to plant cells. This plasmid often contains the virulence functions (Vir genes) that allow infection of plant cells by *Agrobacterium*, and transfer of DNA by cleavage at border sequences and vir-mediated DNA transfer, as is understood in the art (Hellens and Mullineaux, (2000) *Trends in Plant Science* 5:446-451). Several types of *Agrobacterium* strains (e.g. LBA4404, GV3101, EHA101, EHA105, etc.) can be used for plant transformation. The second plasmid vector is not necessary for transforming the plants by other methods such as microprojection, microinjection, electroporation, polyethylene glycol, etc.

In general, plant transformation methods involve transferring heterologous DNA into target plant cells (e.g., immature or mature embryos, suspension cultures, undifferentiated callus, protoplasts, etc.), followed by applying a maximum threshold level of appropriate selection (depending on the selectable marker gene) to recover the transformed plant cells from a group of untransformed cell mass. Following integration of heterologous foreign DNA into plant cells, one then applies a maximum threshold level of appropriate selection in the medium to kill the untransformed cells and separate and proliferate the putatively transformed cells that survive from this selection treatment by transferring regularly to a fresh medium. By continuous passage and challenge with appropriate selection, one can identify and proliferate the cells that are transformed with the plasmid vector. Molecular and biochemical methods can then be used to confirm the presence of the integrated heterologous gene of interest into the genome of the transgenic plant.

Explants are typically transferred to a fresh supply of the same medium and cultured routinely. Subsequently, the transformed cells are differentiated into shoots after placing on regeneration medium supplemented with a maximum threshold level of selecting agent. The shoots are then transferred to a selective rooting medium for recovering rooted shoot or plantlet. The transgenic plantlet then grows into a mature plant and produces fertile seeds (e.g., Hiei, et al., (1994) *The Plant Journal* 6:271-282; Ishida, et al., (1996) *Nature Biotechnology* 14:745-750). Explants are typically transferred to a fresh supply of the same medium and cultured routinely. A general description of the techniques and methods for generating transgenic plants are found in Ayres and Park, (1994) *Critical Reviews in Plant Science* 13:219-239 and Bommineni and Jauhar, (1997) *Maydica* 42:107-120. Since the transformed material contains many cells; both transformed and non-transformed cells are present in any piece of subjected target callus or tissue or group of cells. The ability to kill non-transformed cells and allow transformed cells to proliferate results in transformed plant cultures. Often, the ability to remove non-transformed cells is a limitation to rapid recovery of transformed plant cells and successful generation of transgenic plants.

The cells that have been transformed may be grown into plants in accordance with conventional ways. See, for example, McCormick, et al., (1986) *Plant Cell Reports* 5:81-84. These plants may then be grown, and either pollinated with the same transformed strain or different strains, and the resulting hybrid having constitutive or inducible expression of the desired phenotypic characteristic identified. Two or more generations may be grown to ensure that expression of the desired phenotypic characteristic is stably maintained and inherited and then seeds harvested to ensure that expression of the desired phenotypic characteristic has been achieved.

The nucleotide sequences of the embodiments may be provided to the plant by contacting the plant with a virus or viral nucleic acids. Generally, such methods involve incorporating the nucleotide construct of interest within a viral DNA or RNA molecule. It is recognized that the recombinant proteins of the embodiments may be initially synthesized as part of a viral polyprotein, which later may be processed by proteolysis in vivo or in vitro to produce the desired IPD080 polypeptide. It is also recognized that such a viral polyprotein, comprising at least a portion of the amino acid sequence of an IPD080 of the embodiments, may have the desired pesticidal activity. Such viral polyproteins and the nucleotide sequences that encode for them are encompassed by the embodiments. Methods for providing plants with nucleotide constructs and producing the encoded proteins in the plants, which involve viral DNA or RNA molecules, are known in the art. See, for example, U.S. Pat. Nos. 5,889,191; 5,889,190; 5,866,785; 5,589,367 and 5,316,931; herein incorporated by reference.

Methods for transformation of chloroplasts are known in the art. See, for example, Svab, et al., (1990) *Proc. Natl. Acad. Sci. USA* 87:8526-8530; Svab and Maliga, (1993) *Proc. Natl. Acad. Sci. USA* 90:913-917; Svab and Maliga, (1993) *EMBO J.* 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride, et al., (1994) *Proc. Natl. Acad. Sci. USA* 91:7301-7305.

The embodiments further relate to plant-propagating material of a transformed plant of the embodiments including, but not limited to, seeds, tubers, corms, bulbs, leaves and cuttings of roots and shoots.

The embodiments may be used for transformation of any plant species, including, but not limited to, monocots and dicots. Examples of plants of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables ornamentals, and conifers.

Vegetables include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum. Conifers that may be employed in practicing the embodiments include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas-fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). Plants of the embodiments include crop plants (for example, corn, alfalfa, sunflower, Brassica, soybean, cotton, safflower, peanut, sorghum, wheat, millet, tobacco, etc.), such as corn and soybean plants.

Turf grasses include, but are not limited to: annual bluegrass (*Poa annua*); annual ryegrass (*Lolium multiflorum*); Canada bluegrass (*Poa compressa*); Chewing's fescue (*Festuca rubra*); colonial bentgrass (*Agrostis tenuis*); creeping bentgrass (*Agrostis palustris*); crested wheatgrass (*Agropyron desertorum*); fairway wheatgrass (*Agropyron cristatum*); hard fescue (*Festuca longifolia*); Kentucky bluegrass (*Poa pratensis*); orchardgrass (*Dactylis glomerata*); perennial ryegrass (*Lolium perenne*); red fescue (*Festuca rubra*); redtop (*Agrostis alba*); rough bluegrass (*Poa trivialis*); sheep fescue (*Festuca ovina*); smooth bromegrass (*Bromus inermis*); tall fescue (*Festuca arundinacea*); timothy (*Phleum pratense*); velvet bentgrass (*Agrostis canina*); weeping alkaligrass (*Puccinellia distans*); western wheatgrass (*Agropyron smithii*); Bermuda grass (*Cynodon* spp.); St. Augustine grass (*Stenotaphrum secundatum*); zoysia grass (*Zoysia* spp.); Bahia grass (*Paspalum notatum*); carpet grass (*Axonopus affinis*); centipede grass (*Eremochloa ophiuroides*); kikuyu grass (*Pennisetum clandesinum*); seashore paspalum (*Paspalum vaginatum*); blue gramma (*Bouteloua gracilis*); buffalo grass (*Buchloe dactyloids*); sideoats gramma (*Bouteloua curtipendula*).

Plants of interest include grain plants that provide seeds of interest, oil-seed plants, and leguminous plants. Seeds of interest include grain seeds, such as corn, wheat, barley, rice, sorghum, rye, millet, etc. Oil-seed plants include cotton, soybean, safflower, sunflower, *Brassica*, maize, alfalfa, palm, coconut, flax, castor, olive, etc. Leguminous plants include beans and peas. Beans include guar, locust bean, fenugreek, soybean, garden beans, cowpea, mung bean, lima bean, fava bean, lentils, chickpea, etc.

Evaluation of Plant Transformation Following introduction of heterologous foreign DNA into plant cells, the transformation or integration of heterologous gene in the plant genome is confirmed by various methods such as analysis of nucleic acids, proteins and metabolites associated with the integrated gene.

PCR analysis is a rapid method to screen transformed cells, tissue or shoots for the presence of incorporated gene at the earlier stage before transplanting into the soil (Sambrook and Russell, (2001) Molecular Cloning: A Laboratory Manual. Cold Spring Harbor Laboratory Press, Cold Spring Harbor, N.Y.). PCR is carried out using oligonucleotide primers specific to the gene of interest or *Agrobacterium* vector background, etc.

Plant transformation may be confirmed by Southern blot analysis of genomic DNA (Sambrook and Russell, (2001) supra). In general, total DNA is extracted from the transformant, digested with appropriate restriction enzymes, fractionated in an agarose gel and transferred to a nitrocellulose or nylon membrane. The membrane or "blot" is then probed with, for example, radiolabeled 32P target DNA fragment to confirm the integration of introduced gene into the plant genome according to standard techniques (Sambrook and Russell, (2001) supra).

In Northern blot analysis, RNA is isolated from specific tissues of transformant, fractionated in a formaldehyde agarose gel, and blotted onto a nylon filter according to standard procedures that are routinely used in the art (Sambrook and Russell, (2001) supra). Expression of RNA encoded by the pesticidal gene is then tested by hybridizing the filter to a radioactive probe derived from a pesticidal gene, by methods known in the art (Sambrook and Russell, (2001) supra).

Western blot, biochemical assays and the like may be carried out on the transgenic plants to confirm the presence of protein encoded by the pesticidal gene by standard procedures (Sambrook and Russell, 2001, supra) using antibodies that bind to one or more epitopes present on the IPD080 polypeptide.

Methods to Introduce Genome Editing Technologies into Plants

In some embodiments, the disclosed IPD080 polynucleotide compositions can be introduced into the genome of a plant using genome editing technologies, or previously introduced IPD080 polynucleotides in the genome of a plant may be edited using genome editing technologies. For example, the disclosed polynucleotides can be introduced into a desired location in the genome of a plant through the use of double-stranded break technologies such as TALENs, meganucleases, zinc finger nucleases, CRISPR-Cas, and the like. For example, the disclosed polynucleotides can be introduced into a desired location in a genome using a CRISPR-Cas system, for the purpose of site-specific insertion. The desired location in a plant genome can be any desired target site for insertion, such as a genomic region amenable for breeding or may be a target site located in a genomic window with an existing trait of interest. Existing traits of interest could be either an endogenous trait or a previously introduced trait.

In some embodiments, where the disclosed IPD080 polynucleotide has previously been introduced into a genome, genome editing technologies may be used to alter or modify the introduced polynucleotide sequence. Site specific modifications that can be introduced into the disclosed IPD080 polynucleotide compositions include those produced using any method for introducing site specific modification, including, but not limited to, through the use of gene repair oligonucleotides (e.g. US Publication 2013/0019349), or through the use of double-stranded break technologies such as TALENs, meganucleases, zinc finger nucleases, CRISPR-Cas, and the like. Such technologies can be used to modify the previously introduced polynucleotide through the insertion, deletion or substitution of nucleotides within the introduced polynucleotide. Alternatively, double-stranded break technologies can be used to add additional nucleotide sequences to the introduced polynucleotide. Additional sequences that may be added include, additional expression elements, such as enhancer and promoter sequences. In another embodiment, genome editing technologies may be used to position additional insecticidally-active proteins in close proximity to the disclosed IPD080 polynucleotide compositions disclosed herein within the genome of a plant, to generate molecular stacks of insecticidally-active proteins.

An "altered target site," "altered target sequence." "modified target site," and "modified target sequence" are used interchangeably herein and refer to a target sequence as disclosed herein that comprises at least one alteration when compared to non-altered target sequence. Such "alterations" include, for example: (i) replacement of at least one nucleotide, (ii) a deletion of at least one nucleotide, (iii) an insertion of at least one nucleotide, or (iv) any combination of (i)-(iii).

Stacking of Traits in Transgenic Plant

Transgenic plants may comprise a stack of one or more insecticidal polynucleotides disclosed herein with one or more additional polynucleotides resulting in the production or suppression of multiple polypeptide sequences. Transgenic plants comprising stacks of polynucleotide sequences can be obtained by either or both of traditional breeding methods or through genetic engineering methods. These methods include, but are not limited to, breeding individual lines each comprising a polynucleotide of interest, transforming a transgenic plant comprising a gene disclosed herein with a subsequent gene and co-transformation of genes into a single plant cell. As used herein, the term "stacked" includes having the multiple traits present in the same plant (i.e., both traits are incorporated into the nuclear genome, one trait is incorporated into the nuclear genome and one trait is incorporated into the genome of a plastid or both traits are incorporated into the genome of a plastid). In one non-limiting example, "stacked traits" comprise a molecular stack where the sequences are physically adjacent to each other. A trait, as used herein, refers to the phenotype derived from a particular sequence or groups of sequences. Co-transformation of genes can be carried out using single transformation vectors comprising multiple genes or genes carried separately on multiple vectors. If the sequences are stacked by genetically transforming the plants, the polynucleotide sequences of interest can be combined at any time and in any order. The traits can be introduced simultaneously in a co-transformation protocol with the polynucleotides of interest provided by any combination of transformation cassettes. For example, if two sequences will be introduced, the two sequences can be contained in separate transformation cassettes (trans) or contained on the same transformation cassette (cis). Expression of the sequences can be driven by the same promoter or by different promoters. In certain cases, it may be desirable to introduce a transformation cassette that will suppress the expression of the polynucleotide of interest. This may be combined with any combination of other suppression cassettes or overexpression cassettes to generate the desired combination of traits in the plant. It is further recognized that polynucleotide sequences can be stacked at a desired genomic location using a site-specific recombination system. See, for example, WO 1999/25821, WO 1999/25854, WO 1999/25840, WO 1999/25855 and WO 1999/25853, all of which are herein incorporated by reference.

In some embodiments the polynucleotides encoding the IPD080 polypeptide disclosed herein, alone or stacked with one or more additional insect resistance traits can be stacked with one or more additional input traits (e.g., herbicide resistance, fungal resistance, virus resistance, stress tolerance, disease resistance, male sterility, stalk strength, and the like) or output traits (e.g., increased yield, modified starches, improved oil profile, balanced amino acids, high lysine or methionine, increased digestibility, improved fiber quality, drought resistance, and the like). Thus, the polynucleotide embodiments can be used to provide a complete agronomic package of improved crop quality with the ability to flexibly and cost effectively control any number of agronomic pests.

Transgenes useful for stacking include but are not limited to:

1. Transgenes that Confer Resistance to Insects or Disease and that Encode:

(A) Plant disease resistance genes. Plant defenses are often activated by specific interaction between the product of a disease resistance gene (R) in the plant and the product of a corresponding avirulence (Avr) gene in the pathogen. A plant variety can be transformed with cloned resistance gene to engineer plants that are resistant to specific pathogen strains. See, for example, Jones, et al., (1994) *Science* 266:789 (cloning of the tomato Cf-9 gene for resistance to *Cladosporium fulvum*); Martin, et al., (1993) *Science* 262:1432 (tomato Pto gene for resistance to *Pseudomonas syringae* pv. tomato encodes a protein kinase); Mindrinos, et al., (1994) *Cell* 78:1089 (*Arabidopsis* RSP2 gene for resistance to *Pseudomonas syringae*), McDowell and Woffenden, (2003) *Trends Biotechnol.* 21(4):178-83 and Toyoda, et al., (2002) *Transgenic Res.* 11(6):567-82. A plant resistant to a disease is one that is more resistant to a pathogen as compared to the wild type plant.

(B) Genes encoding a *Bacillus thuringiensis* protein, a derivative thereof or a synthetic polypeptide modeled thereon. See, for example, Geiser, et al., (1986) *Gene* 48:109, who disclose the cloning and nucleotide sequence of a Bt delta-endotoxin gene. Moreover, DNA molecules encoding delta-endotoxin genes can be purchased from American Type Culture Collection (Rockville, Md.), for example, under ATCC® Accession Numbers 40098, 67136, 31995 and 31998. Other non-limiting examples of *Bacillus thuringiensis* transgenes being genetically engineered are given in the following patents and patent applications and hereby are incorporated by reference for this purpose: U.S. Pat. Nos. 5,188,960; 5,689,052; 5,880,275; 5,986,177; 6,023,013, 6,060,594, 6,063,597, 6,077,824, 6,620,988, 6,642,030, 6,713,259, 6,893,826, 7,105,332; 7,179,965, 7,208,474; 7,227,056, 7,288,643, 7,323,556, 7,329,736, 7,449,552, 7,468,278, 7,510,878, 7,521,235, 7,544,862, 7,605,304, 7,696,412, 7,629,504, 7,705,216, 7,772,465, 7,790,846, 7,858,849 and WO 1991/14778; WO 1999/31248; WO 2001/12731; WO 1999/24581 and WO 1997/40162.

Genes encoding pesticidal proteins may also be stacked including but are not limited to: insecticidal proteins from *Pseudomonas* sp. such as PSEEN3174 (Monalysin, (2011) *PLoS Pathogens*, 7:1-13), from *Pseudomonas protegens* strain CHAO and Pf-5 (previously *fluorescens*) (Pechy-Tarr, (2008) *Environmental Microbiology* 10:2368-2386: GenBank Accession No. EU400157); from *Pseudomonas taiwanensis* (Liu, et al., (2010) *J. Agric. Food Chem.* 58:12343-12349) and from *Pseudomonas pseudoalcaligenes* (Zhang, et al., (2009) *Annals of Microbiology* 59:45-50 and Li, et al., (2007) *Plant Cell Tiss. Organ Cult.* 89:159-168); insecticidal proteins from *Photorhabdus* sp. and *Xenorhabdus* sp. (Hinchliffe, et al., (2010) *The Open Toxinology Journal* 3:101-118 and Morgan, et al., (2001) *Applied and Envir. Micro.* 67:2062-2069), U.S. Pat. Nos. 6,048,838, and 6,379,946; a PIP-1 polypeptide of US Patent Publication US20140007292; an AfIP-1A and/or AfIP-1B polypeptide of US Patent Publication US20140033361; a PHI-4 polypeptide of US Patent Publication US20140274885 and US20160040184; a PIP-47 polypeptide of PCT Publication Number WO2015/023846, a PIP-72 polypeptide of PCT Publication Number WO2015/038734; a PtIP-50 polypeptide and a PtIP-65 polypeptide of PCT Publication Number WO2015/120270; a PtIP-83 polypeptide of PCT Publication Number WO2015/120276; a PtIP-96 polypeptide of PCT Serial Number PCT/US15/55502; an IPD079 polypeptide of U.S. Ser. No. 62/201,977; an IPD082 polypeptide of U.S. Ser. No. 62/269,482, and δ-endotoxins including, but not limited to, the Cry1, Cry2, Cry3, Cry4, Cry5, Cry6, Cry7, Cry8, Cry9, Cry10, Cry11, Cry12, Cry13, Cry14, Cry15, Cry16, Cry17, Cry18, Cry19, Cry20, Cry21, Cry22, Cry23, Cry24, Cry25, Cry26, Cry27, Cry 28, Cry 29, Cry 30, Cry31, Cry32, Cry33, Cry34, Cry35, Cry36, Cry37, Cry38, Cry39, Cry40, Cry41, Cry42, Cry43, Cry44, Cry45, Cry 46, Cry47, Cry49, Cry50, Cry51, Cry52, Cry53, Cry 54, Cry55, Cry56, Cry57, Cry58, Cry59, Cry60, Cry61, Cry62, Cry63, Cry64, Cry65, Cry66, Cry67, Cry68, Cry69, Cry70, Cry71, and Cry 72 classes of δ-endotoxin genes and the *B. thuringiensis* cytolytic Cyt1 and Cyt2 genes. Members of these classes of *B. thuringiensis* insecticidal proteins well known to one skilled in the art (see, Crickmore, et al., "*Bacillus thuringiensis* toxin nomenclature" (2011), at lifesci.sussex.ac.uk/home/Neil_Crickmore/Bt/ which can be accessed on the world-wide web using the "www" prefix).

Examples of δ-endotoxins also include but are not limited to Cry1A proteins of U.S. Pat. Nos. 5,880,275 and 7,858,849; a DIG-3 or DIG-11 toxin (N-terminal deletion of α-helix 1 and/or α-helix 2 variants of Cry proteins such as Cry1A) of U.S. Pat. Nos. 8,304,604 and 8,304,605, Cry1B of U.S. patent application Ser. No. 10/525,318; Cry1C of U.S. Pat. No. 6,033,874; Cry1F of U.S. Pat. Nos. 5,188,960, 6,218,188; Cry1A/F chimeras of U.S. Pat. Nos. 7,070,982; 6,962,705 and 6,713,063); a Cry2 protein such as Cry2Ab protein of U.S. Pat. No. 7,064,249); a Cry3A protein including but not limited to an engineered hybrid insecticidal protein (eHIP) created by fusing unique combinations of variable regions and conserved blocks of at least two different Cry proteins (US Patent Application Publication Number 2010/0017914); a Cry4 protein; a Cry5 protein; a Cry6 protein; Cry8 proteins of U.S. Pat. Nos. 7,329,736, 7,449,552, 7,803,943, 7,476,781, 7,105,332, 7,378,499 and 7,462,760; a Cry9 protein such as such as members of the Cry9A, Cry9B, Cry9C, Cry9D, Cry9E, and Cry9F families; a Cry15 protein of Naimov, et al., (2008) *Applied and Environmental Microbiology* 74:7145-7151; a Cry22, a Cry34Ab1 protein of U.S. Pat. Nos. 6,127,180, 6,624,145 and 6,340,593; a CryET33 and CryET34 protein of U.S. Pat. Nos. 6,248,535, 6,326,351, 6,399,330, 6,949,626, 7,385,107 and 7,504,229; a CryET33 and CryET34 homologs of US Patent Publication Number 2006/0191034, 2012/0278954, and PCT Publication Number WO 2012/139004; a Cry35Ab1 protein of U.S. Pat. Nos. 6,083,499, 6,548,291 and 6,340,593; a Cry46 protein, a Cry 51 protein, a Cry binary toxin; a TIC901 or related toxin; TIC807 of US 2008/0295207; ET29, ET37, TIC809, TIC810, TIC812, TIC127, TIC128 of PCT US 2006/033867; AXMI-027, AXMI-036, and AXMI-038 of U.S. Pat. No. 8,236,757;

AXMI-031, AXMI-039, AXMI-040, AXMI-049 of U.S. Pat. No. 7,923,602; AXMI-018, AXMI-020, and AXMI-021 of WO 2006/083891; AXMI-010 of WO 2005/038032; AXMI-003 of WO 2005/021585; AXMI-008 of US 2004/0250311; AXMI-006 of US 2004/0216186; AXMI-007 of US 2004/0210965; AXMI-009 of US 2004/0210964; AXMI-014 of US 2004/0197917; AXMI-004 of US 2004/0197916; AXMI-028 and AXMI-029 of WO 2006/119457; AXMI-007, AXMI-008, AXMI-0080rf2, AXMI-009, AXMI-014 and AXMI-004 of WO 2004/074462; AXMI-150 of U.S. Pat. No. 8,084,416; AXMI-205 of US20110023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063, and AXMI-064 of US 2011/0263488; AXMI-R1 and related proteins of US 2010/0197592; AXMI221Z, AXMI222z, AXMI223z, AXMI224z and AXMI225z of WO 2011/103248; AXMI218, AXMI219, AXMI220, AXMI226, AXMI227, AXMI228, AXMI229, AXMI230, and AXMI231 of WO11/103247; AXMI-115, AXMI-113, AXMI-005, AXMI-163 and AXMI-184 of U.S. Pat. No. 8,334,431; AXMI-001, AXMI-002, AXMI-030, AXMI-035, and AXMI-045 of US 2010/0298211; AXMI-066 and AXMI-076 of US2009/0144852; AXMI128, AXMI130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900; AXMI079, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, AXMI111, AXMI112, AXMI114, AXMI116, AXMI117, AXMI118, AXMI119, AXMI120, AXMI121, AXMI122, AXMI123, AXMI124, AXMI1257, AXMI1268, AXMI127, AXMI129, AXMI164, AXMI151, AXMI161, AXMI183, AXMI132, AXMI138, AXMI137 of US 2010/0005543; and Cry proteins such as Cry1A and Cry3A having modified proteolytic sites of U.S. Pat. No. 8,319,019; and a Cry1Ac, Cry2Aa and Cry1Ca toxin protein from *Bacillus thuringiensis* strain VBTS 2528 of US Patent Application Publication Number 2011/0064710. Other Cry proteins are well known to one skilled in the art (see, Crickmore, et al., "*Bacillus thuringiensis* toxin nomenclature" (2011), at lifesci.sussex.ac.uk/home/Neil_Crickmore/Bt/which can be accessed on the world-wide web using the "www" prefix). The insecticidal activity of Cry proteins is well known to one skilled in the art (for review, see, van Frannkenhuyzen, (2009) J. Invert. Path. 101:1-16). The use of Cry proteins as transgenic plant traits is well known to one skilled in the art and Cry-transgenic plants including but not limited to Cry1Ac, Cry1Ac+Cry2Ab, Cry1Ab, Cry1A.105, Cry1F, Cry1Fa2, Cry1F+Cry1Ac, Cry2Ab, Cry3A, mCry3A, Cry3Bb1, Cry34Ab1, Cry35Ab1, Vip3A, mCry3A, Cry9c and CBI-Bt have received regulatory approval (see, Sanahuja, (2011) Plant Biotech Journal 9:283-300 and the CERA (2010) GM Crop Database Center for Environmental Risk Assessment (CERA), ILSI Research Foundation, Washington D.C. at cera-gmc.org/index.php?action=gm_crop_database which can be accessed on the world-wide web using the "www" prefix). More than one pesticidal proteins well known to one skilled in the art can also be expressed in plants such as Vip3Ab & Cry1 Fa (US2012/0317682), Cry1BE & Cry1F (US2012/0311746), Cry1CA & Cry1AB (US2012/0311745), Cry1F & CryCa (US2012/0317681), Cry1DA & Cry1BE (US2012/0331590), Cry1DA & Cry1Fa (US2012/0331589), Cry1AB & Cry1BE (US2012/0324606), and Cry1Fa & Cry2Aa, Cry1I or Cry1E (US2012/0324605). Pesticidal proteins also include insecticidal lipases including lipid acyl hydrolases of U.S. Pat. No. 7,491,869, and cholesterol oxidases such as from *Streptomyces* (Purcell et al. (1993) *Biochem Biophys Res Commun* 15:1406-1413). Pesticidal proteins also include VIP (vegetative insecticidal proteins) toxins of U.S. Pat. Nos. 5,877,012, 6,107,279, 6,137,033, 7,244,820, 7,615,686, and 8,237,020, and the like.

Other VIP proteins are well known to one skilled in the art (see, lifesci.sussex.ac.uk/home/Neil_Crickmore/Bt/vip.html which can be accessed on the world-wide web using the "www" prefix). Pesticidal proteins also include toxin complex (TC) proteins, obtainable from organisms such as *Xenorhabdus, Photorhabdus* and *Paenibacillus* (see, U.S. Pat. Nos. 7,491,698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus, Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptB1Xb and XptC1Wi. Examples of Class C proteins are TccC, XptC1Xb and XptB1Wi. Pesticidal proteins also include spider, snake and scorpion venom proteins. Examples of spider venom peptides include but are not limited to lycotoxin-1 peptides and mutants thereof (U.S. Pat. No. 8,334,366).

(C) A polynucleotide encoding an insect-specific hormone or pheromone such as an ecdysteroid and juvenile hormone, a variant thereof, a mimetic based thereon or an antagonist or agonist thereof. See, for example, the disclosure by Hammock, et al., (1990) Nature 344:458, of baculovirus expression of cloned juvenile hormone esterase, an inactivator of juvenile hormone.

(D) A polynucleotide encoding an insect-specific peptide which, upon expression, disrupts the physiology of the affected pest. For example, see the disclosures of, Regan, (1994) *J. Biol. Chem.* 269:9 (expression cloning yields DNA coding for insect diuretic hormone receptor); Pratt, et al., (1989) *Biochem. Biophys. Res. Comm.* 163:1243 (an allostatin is identified in *Diploptera puntata*); Chattopadhyay, et al., (2004) *Critical Reviews in Microbiology* 30(1):33-54; Zjawiony, (2004) *J Nat Prod* 67(2):300-310; Carlini and Grossi-de-Sa, (2002) *Toxicon* 40(11):1515-1539; Ussuf, et al., (2001) *Curr Sci.* 80(7):847-853 and Vasconcelos and Oliveira, (2004) *Toxicon* 44(4):385-403. See also, U.S. Pat. No. 5,266,317 to Tomalski, et al., who disclose genes encoding insect-specific toxins.

(E) A polynucleotide encoding an enzyme responsible for a hyperaccumulation of a monoterpene, a sesquiterpene, a steroid, hydroxamic acid, a phenylpropanoid derivative or another non-protein molecule with insecticidal activity.

(F) A polynucleotide encoding an enzyme involved in the modification, including the post-translational modification, of a biologically active molecule; for example, a glycolytic enzyme, a proteolytic enzyme, a lipolytic enzyme, a nuclease, a cyclase, a transaminase, an esterase, a hydrolase, a phosphatase, a kinase, a phosphorylase, a polymerase, an elastase, a chitinase and a glucanase, whether natural or synthetic. See, PCT Application WO 1993/02197 in the name of Scott, et al., which discloses the nucleotide sequence of a callase gene. DNA molecules which contain chitinase-encoding sequences can be obtained, for example, from the ATCC® under Accession Numbers 39637 and 67152. See also, Kramer, et al., (1993) *Insect Biochem. Molec. Biol.* 23:691, who teach the nucleotide sequence of a cDNA encoding tobacco hookworm chitinase and Kawalleck, et al., (1993) *Plant Molec. Biol.* 21:673, who provide the nucleotide sequence of the parsley ubi4-2 polyubiquitin gene, and U.S. Pat. Nos. 6,563,020; 7,145,060 and 7,087,810.

(G) A polynucleotide encoding a molecule that stimulates signal transduction. For example, see the disclosure by Botella, et al., (1994) *Plant Molec. Biol.* 24:757, of nucleotide sequences for mung bean calmodulin cDNA clones, and Griess, et al., (1994) *Plant Physiol.* 104:1467, who provide the nucleotide sequence of a maize calmodulin cDNA clone.

(H) A polynucleotide encoding a hydrophobic moment peptide. See, PCT Application WO 1995/16776 and U.S. Pat. No. 5,580,852 disclosure of peptide derivatives of Tachyplesin which inhibit fungal plant pathogens) and PCT Application WO 1995/18855 and U.S. Pat. No. 5,607,914 (teaches synthetic antimicrobial peptides that confer disease resistance).

(I) A polynucleotide encoding a membrane permease, a channel former or a channel blocker. For example, see the disclosure by Jaynes, et al., (1993) *Plant Sci.* 89:43, of heterologous expression of a cecropin-beta lytic peptide analog to render transgenic tobacco plants resistant to *Pseudomonas solanacearum*.

(J) A gene encoding a viral-invasive protein or a complex toxin derived therefrom. For example, the accumulation of viral coat proteins in transformed plant cells imparts resistance to viral infection and/or disease development effected by the virus from which the coat protein gene is derived, as well as by related viruses. See, Beachy, et al., (1990) *Ann. Rev. Phytopathol.* 28:451. Coat protein-mediated resistance has been conferred upon transformed plants against alfalfa mosaic virus, cucumber mosaic virus, tobacco streak virus, potato virus X, potato virus Y, tobacco etch virus, tobacco rattle virus and tobacco mosaic virus. Id.

(K) A gene encoding an insect-specific antibody or an immunotoxin derived therefrom. Thus, an antibody targeted to a critical metabolic function in the insect gut would inactivate an affected enzyme, killing the insect. Cf. Taylor, et al., Abstract #497, SEVENTH INT'L SYMPOSIUM ON MOLECULAR PLANT-MICROBE INTERACTIONS (Edinburgh, Scotland, 1994) (enzymatic inactivation in transgenic tobacco via production of single-chain antibody fragments).

(L) A gene encoding a virus-specific antibody. See, for example, Tavladoraki, et al., (1993) *Nature* 366:469, who show that transgenic plants expressing recombinant antibody genes are protected from virus attack.

(M) A polynucleotide encoding a developmental-arrestive protein produced in nature by a pathogen or a parasite. Thus, fungal endo alpha-1,4-D-polygalacturonases facilitate fungal colonization and plant nutrient release by solubilizing plant cell wall homo-alpha-1,4-D-galacturonase. See, Lamb, et al., (1992) *Bio/Technology* 10:1436. The cloning and characterization of a gene which encodes a bean endopolygalacturonase-inhibiting protein is described by Toubart, et al., (1992) *Plant J.* 2:367.

(N) A polynucleotide encoding a developmental-arrestive protein produced in nature by a plant. For example, Logemann, et al., (1992) *Bio/Technology* 10:305, have shown that transgenic plants expressing the barley ribosome-inactivating gene have an increased resistance to fungal disease.

(O) Genes involved in the Systemic Acquired Resistance (SAR) Response and/or the pathogenesis related genes. Briggs, (1995) *Current Biology* 5(2), Pieterse and Van Loon, (2004) *Curr. Opin. Plant Bio.* 7(4):456-64 and Somssich, (2003) *Cell* 113(7):815-6.

(P) Antifungal genes (Cornelissen and Melchers, (1993) *Pl. Physiol.* 101:709-712 and Parijs, et al., (1991) *Planta* 183:258-264 and Bushnell, et al., (1998) *Can. J. of Plant Path.* 20(2):137-149. Also see, U.S. patent application Ser. Nos. 09/950,933; 11/619,645; 11/657,710; 11/748,994; 11/774,121 and U.S. Pat. Nos. 6,891,085 and 7,306,946. LysM Receptor-like kinases for the perception of chitin fragments as a first step in plant defense response against fungal pathogens (US 2012/0110696).

(Q) Detoxification genes, such as for fumonisin, beauvericin, moniliformin and zearalenone and their structurally related derivatives. For example, see, U.S. Pat. Nos. 5,716,820; 5,792,931; 5,798,255; 5,846,812; 6,083,736; 6,538,177; 6,388,171 and 6,812,380.

(R) A polynucleotide encoding a Cystatin and cysteine proteinase inhibitors. See, U.S. Pat. No. 7,205,453.

(S) Defensin genes. See, WO 2003/000863 and U.S. Pat. Nos. 6,911,577; 6,855,865; 6,777,592 and 7,238,781.

(T) Genes conferring resistance to nematodes. See, e.g., PCT Application WO 1996/30517; PCT Application WO 1993/19181, WO 2003/033651 and Urwin, et al., (1998) *Planta* 204:472-479, Williamson, (1999) *Curr Opin Plant Bio.* 2(4):327-31; U.S. Pat. Nos. 6,284,948 and 7,301,069 and miR164 genes (WO 2012/058266).

(U) Genes that confer resistance to *Phytophthora* Root Rot, such as the Rps 1, Rps 1-a, Rps 1-b, Rps 1-c, Rps 1-d, Rps 1-e, Rps 1-k, Rps 2, Rps 3-a, Rps 3-b, Rps 3-c, Rps 4, Rps 5, Rps 6, Rps 7 and other Rps genes. See, for example, Shoemaker, et al., *Phytophthora* Root Rot Resistance Gene Mapping in Soybean, Plant Genome IV Conference, San Diego, Calif. (1995).

(V) Genes that confer resistance to Brown Stem Rot, such as described in U.S. Pat. No. 5,689,035 and incorporated by reference for this purpose.

(W) Genes that confer resistance to Colletotrichum, such as described in US Patent Application Publication US 2009/0035765 and incorporated by reference for this purpose. This includes the Rcg locus that may be utilized as a single locus conversion.

2. Transgenes that Confer Resistance to a Herbicide, for Example:

(A) A polynucleotide encoding resistance to a herbicide that inhibits the growing point or meristem, such as an imidazolinone or a sulfonylurea. Exemplary genes in this category code for mutant ALS and AHAS enzyme as described, for example, by Lee, et al., (1988) *EMBO J.* 7:1241 and Miki, et al., (1990) *Theor. Appl. Genet.* 80:449, respectively. See also, U.S. Pat. Nos. 5,605,011; 5,013,659; 5,141,870; 5,767,361; 5,731,180; 5,304,732; 4,761,373; 5,331,107; 5,928,937 and 5,378,824; U.S. patent application Ser. No. 11/683,737 and International Publication WO 1996/33270.

(B) A polynucleotide encoding a protein for resistance to Glyphosate (resistance imparted by mutant 5-enolpyruvl-3- phosphikimate synthase (EPSP) and aroA genes, respectively) and other phosphono compounds such as glufosinate (phosphinothricin acetyl transferase (PAT) and *Streptomyces hygroscopicus* phosphinothricin acetyl transferase (bar) genes), and pyridinoxy or phenoxy proprionic acids and cyclohexones (ACCase inhibitor-encoding genes). See, for example, U.S. Pat. No. 4,940,835 to Shah, et al., which discloses the nucleotide sequence of a form of EPSPS which can confer glyphosate resistance. U.S. Pat. No. 5,627,061 to Barry, et al., also describes genes encoding EPSPS enzymes. See also, U.S. Pat. Nos. 6,566,587; 6,338,961; 6,248,876; 6,040,497; 5,804,425; 5,633,435; 5,145,783; 4,971,908; 5,312,910; 5,188,642; 5,094,945; 4,940,835; 5,866,775; 6,225,114; 6,130,366; 5,310,667; 4,535,060; 4,769,061; 5,633,448; 5,510,471; Re. 36,449; RE 37,287 E and 5,491, 288 and International Publications EP 1173580; WO 2001/66704; EP 1173581 and EP 1173582, which are incorporated herein by reference for this purpose. Glyphosate resistance is also imparted to plants that express a gene encoding a glyphosate oxido-reductase enzyme as described more fully in U.S. Pat. Nos. 5,776,760 and 5,463,175, which are incorporated herein by reference for this purpose. In addition glyphosate resistance can be imparted to plants by the over expression of genes encoding glyphosate N-acetyltransferase. See, for example, U.S. Pat. Nos. 7,462,481; 7,405,074 and US Patent Application Publication Number US 2008/0234130. A DNA molecule encoding a mutant aroA gene can be obtained under ATCC® Accession Number 39256, and the nucleotide sequence of the mutant gene is disclosed in U.S. Pat. No. 4,769,061 to Comai. EP Application Number 0 333 033 to Kumada, et al., and U.S. Pat. No. 4,975,374 to Goodman, et al., disclose nucleotide sequences of glutamine synthetase genes which confer resistance to herbicides such as L-phosphinothricin. The nucleotide sequence of a phosphinothricin-acetyl-transferase gene is provided in EP Application Numbers 0 242 246 and 0 242 236 to Leemans, et al., De Greef, et al., (1989) *Bio/Technology* 7:61, describe the production of transgenic plants that express chimeric bar genes coding for phosphinothricin acetyl transferase activity. See also, U.S. Pat. Nos. 5,969,213; 5,489,520; 5,550, 318; 5,874,265; 5,919,675; 5,561,236; 5,648,477; 5,646, 024; 6,177,616 and 5,879,903, which are incorporated herein by reference for this purpose. Exemplary genes conferring resistance to phenoxy proprionic acids and cyclohexones, such as sethoxydim and haloxyfop, are the Acc1-S1, Acc1-S2 and Acc1-S3 genes described by Marshall, et al., (1992) Theor. Appl. Genet. 83:435.

(C) A polynucleotide encoding a protein for resistance to herbicide that inhibits photosynthesis, such as a triazine (psbA and gs+ genes) and a benzonitrile (nitrilase gene). Przibilla, et al., (1991) Plant Cell 3:169, describe the transformation of *Chlamydomonas* with plasmids encoding mutant psbA genes. Nucleotide sequences for nitrilase genes are disclosed in U.S. Pat. No. 4,810,648 to Stalker and DNA molecules containing these genes are available under ATCC® Accession Numbers 53435, 67441 and 67442. Cloning and expression of DNA coding for a glutathione S-transferase is described by Hayes, et al., (1992) *Biochem. J.* 285:173.

(D) A polynucleotide encoding a protein for resistance to Acetohydroxy acid synthase, which has been found to make plants that express this enzyme resistant to multiple types of herbicides, has been introduced into a variety of plants (see, e.g., Hattori, et al., (1995) *Mol Gen Genet.* 246:419). Other genes that confer resistance to herbicides include: a gene encoding a chimeric protein of rat cytochrome P4507A1 and yeast NADPH-cytochrome P450 oxidoreductase (Shiota, et al., (1994) *Plant Physiol* 106:17), genes for glutathione reductase and superoxide dismutase (Aono, et al., (1995) *Plant Cell Physiol* 36:1687) and genes for various phosphotransferases (Datta, et al., (1992) *Plant Mol Biol* 20:619).

(E) A polynucleotide encoding resistance to a herbicide targeting Protoporphyrinogen oxidase (protox) which is necessary for the production of chlorophyll. The protox enzyme serves as the target for a variety of herbicidal compounds. These herbicides also inhibit growth of all the different species of plants present, causing their total destruction. The development of plants containing altered protox activity which are resistant to these herbicides are described in U.S. Pat. Nos. 6,288,306; 6,282,83 and 5,767, 373 and International Publication WO 2001/12825.

(F) The aad-1 gene (originally from *Sphingobium herbicidovorans*) encodes the aryloxyalkanoate dioxygenase (AAD-1) protein. The trait confers tolerance to 2,4-dichlorophenoxyacetic acid and aryloxyphenoxypropionate (commonly referred to as "fop" herbicides such as quizalofop) herbicides. The aad-1 gene, itself, for herbicide tolerance in plants was first disclosed in WO 2005/107437 (see also, US 2009/0093366). The aad-12 gene, derived from *Delftia acidovorans*, which encodes the aryloxyalkanoate dioxygenase (AAD-12) protein that confers tolerance to 2,4-dichlorophenoxyacetic acid and pyridyloxyacetate herbicides by deactivating several herbicides with an aryloxyalkanoate moiety, including phenoxy auxin (e.g., 2,4-D, MCPA), as well as pyridyloxy auxins (e.g., fluroxypyr, triclopyr).

(G) A polynucleotide encoding a herbicide resistant dicamba monooxygenase disclosed in US Patent Application Publication 2003/0135879 for imparting dicamba tolerance;

(H) A polynucleotide molecule encoding bromoxynil nitrilase (Bxn) disclosed in U.S. Pat. No. 4,810,648 for imparting bromoxynil tolerance;

(I) A polynucleotide molecule encoding phytoene (crtI) described in Misawa, et al., (1993) *Plant J.* 4:833-840 and in Misawa, et al., (1994) *Plant J.* 6:481-489 for norflurazon tolerance.

3. Transgenes that Confer or Contribute to an Altered Grain Characteristic Such as:

(A) Altered fatty acids, for example, by (1) Down-regulation of stearoyl-ACP to increase stearic acid content of the plant. See, Knultzon, et al., (1992) *Proc. Natl. Acad. Sci. USA* 89:2624 and WO 1999/64579 (Genes to Alter Lipid Profiles in Corn).

(2) Elevating oleic acid via FAD-2 gene modification and/or decreasing linolenic acid via FAD-3 gene modification (see, U.S. Pat. Nos. 6,063,947; 6,323,392; 6,372,965 and WO 1993/11245).

(3) Altering conjugated linolenic or linoleic acid content, such as in WO 2001/12800.

(4) Altering LEC1, AGP, Dek1, Superal1, mi1 ps, and various Ipa genes such as Ipa1, Ipa3, hpt or hggt. For example, see, WO 2002/42424, WO 1998/22604, WO 2003/011015, WO 2002/057439, WO 2003/011015, U.S. Pat. Nos. 6,423,886, 6,197,561, 6,825,397 and US Patent Application Publication Numbers US 2003/0079247, US 2003/0204870 and Rivera-Madrid, et al., (1995) *Proc. Natl. Acad. Sci.* 92:5620-5624.

(5) Genes encoding delta-8 desaturase for making long-chain polyunsaturated fatty acids (U.S. Pat. Nos. 8,058,571 and 8,338,152), delta-9 desaturase for lowering saturated fats (U.S. Pat. No. 8,063,269), Primula Δ6-desaturase for improving omega-3 fatty acid profiles.

(6) Isolated nucleic acids and proteins associated with lipid and sugar metabolism regulation, in particular, lipid metabolism protein (LMP) used in methods of producing transgenic plants and modulating levels of seed storage compounds including lipids, fatty acids, starches or seed storage proteins and use in methods of modulating the seed size, seed number, seed weights, root length and leaf size of plants (EP 2404499).

(7) Altering expression of a High-Level Expression of Sugar-Inducible 2 (HSI2) protein in the plant to increase or decrease expression of HSI2 in the plant. Increasing expression of HSI2 increases oil content while decreasing expression of HSI2 decreases abscisic acid sensitivity and/or increases drought resistance (US Patent Application Publication Number 2012/0066794).

(8) Expression of cytochrome b5 (Cb5) alone or with FAD2 to modulate oil content in plant seed, particularly to increase the levels of omega-3 fatty acids and improve the ratio of omega-6 to omega-3 fatty acids (US Patent Application Publication Number 2011/0191904).

(9) Nucleic acid molecules encoding wrinkled1-like polypeptides for modulating sugar metabolism (U.S. Pat. No. 8,217,223).

(B) Altered phosphorus content, for example, by the (1) Introduction of a phytase-encoding gene would enhance breakdown of phytate, adding more free phosphate to the transformed plant. For example, see, Van Hartingsveldt, et al., (1993) *Gene* 127:87, for a disclosure of the nucleotide sequence of an *Aspergillus niger* phytase gene.

(2) Modulating a gene that reduces phytate content. In maize, this, for example, could be accomplished, by cloning and then re-introducing DNA associated with one or more of the alleles, such as the LPA alleles, identified in maize mutants characterized by low levels of phytic acid, such as in WO 2005/113778 and/or by altering inositol kinase activity as in WO 2002/059324, US Patent Application Publication Number 2003/0009011, WO 2003/027243, US Patent Application Publication Number 2003/0079247, WO 1999/05298, U.S. Pat. Nos. 6,197,561, 6,291,224, 6,391, 348, WO 2002/059324, US Patent Application Publication Number 2003/0079247, WO 1998/45448, WO 1999/55882, WO 2001/04147.

(C) Altered carbohydrates affected, for example, by altering a gene for an enzyme that affects the branching pattern of starch or, a gene altering thioredoxin such as NTR and/or TRX (see, U.S. Pat. No. 6,531,648. which is incorporated by reference for this purpose) and/or a gamma zein knock out or mutant such as cs27 or TUSC27 or en27 (see, U.S. Pat. No. 6,858,778 and US Patent Application Publication Number 2005/0160488, US Patent Application Publication Number 2005/0204418, which are incorporated by reference for this purpose). See, Shiroza, et al., (1988) *J. Bacteriol.* 170:810 (nucleotide sequence of *Streptococcus* mutant fructosyltransferase gene), Steinmetz, et al., (1985) *Mol. Gen. Genet.* 200:220 (nucleotide sequence of *Bacillus subtilis* levansucrase gene), Pen, et al., (1992) *Bio/Technology* 10:292 (production of transgenic plants that express *Bacillus licheniformis* alpha-amylase), Elliot, et al., (1993) *Plant Molec. Biol.* 21:515 (nucleotide sequences of tomato invertase genes), Søgaard, et al., (1993) *J. Biol. Chem.* 268:22480 (site-directed mutagenesis of barley alpha-amylase gene) and Fisher, et al., (1993) *Plant Physiol.* 102:1045 (maize endosperm starch branching enzyme II), WO 1999/10498 (improved digestibility and/or starch extraction through modification of UDP-D-xylose 4-epimerase, Fragile 1 and 2, Ref1, HCHL, C4H), U.S. Pat. No. 6,232,529 (method of producing high oil seed by modification of starch levels (AGP)). The fatty acid modification genes mentioned herein may also be used to affect starch content and/or composition through the interrelationship of the starch and oil pathways.

(D) Altered antioxidant content or composition, such as alteration of tocopherol or tocotrienols. For example, see, U.S. Pat. No. 6,787,683, US Patent Application Publication Number 2004/0034886 and WO 2000/68393 involving the manipulation of antioxidant levels and WO 2003/082899 through alteration of a homogentisate geranyl geranyl transferase (hggt).

(E) Altered essential seed amino acids. For example, see, U.S. Pat. No. 6,127,600 (method of increasing accumulation of essential amino acids in seeds), U.S. Pat. No. 6,080,913 (binary methods of increasing accumulation of essential amino acids in seeds), U.S. Pat. No. 5,990,389 (high lysine), WO 1999/40209 (alteration of amino acid compositions in seeds), WO 1999/29882 (methods for altering amino acid content of proteins), U.S. Pat. No. 5,850,016 (alteration of amino acid compositions in seeds), WO 1998/20133 (proteins with enhanced levels of essential amino acids), U.S. Pat. No. 5,885,802 (high methionine), U.S. Pat. No. 5,885,801 (high threonine), U.S. Pat. No. 6,664,445 (plant amino acid biosynthetic enzymes), U.S. Pat. No. 6,459,019 (increased lysine and threonine), U.S. Pat. No. 6,441,274 (plant tryptophan synthase beta subunit), U.S. Pat. No. 6,346,403 (methionine metabolic enzymes), U.S. Pat. No. 5,939,599 (high sulfur), U.S. Pat. No. 5,912,414 (increased methionine), WO 1998/56935 (plant amino acid biosynthetic enzymes), WO 1998/45458 (engineered seed protein having higher percentage of essential amino acids), WO 1998/42831 (increased lysine), U.S. Pat. No. 5,633,436 (increasing sulfur amino acid content), U.S. Pat. No. 5,559,223 (synthetic storage proteins with defined structure containing programmable levels of essential amino acids for improvement of the nutritional value of plants), WO 1996/01905 (increased threonine), WO 1995/15392 (increased lysine), US Patent Application Publication Number 2003/0163838, US Patent Application Publication Number 2003/0150014, US Patent Application Publication Number 2004/0068767, U.S. Pat. No. 6,803,498, WO 2001/79516.

4. Genes that Control Male-Sterility:

There are several methods of conferring genetic male sterility available, such as multiple mutant genes at separate locations within the genome that confer male sterility, as disclosed in U.S. Pat. Nos. 4,654,465 and 4,727,219 to Brar, et al., and chromosomal translocations as described by Patterson in U.S. Pat. Nos. 3,861,709 and 3,710,511. In addition to these methods, Albertsen, et al., U.S. Pat. No. 5,432,068, describe a system of nuclear male sterility which includes: identifying a gene which is critical to male fertility; silencing this native gene which is critical to male fertility; removing the native promoter from the essential male fertility gene and replacing it with an inducible promoter; inserting this genetically engineered gene back into the plant; and thus creating a plant that is male sterile because the inducible promoter is not "on" resulting in the male fertility gene not being transcribed. Fertility is restored by inducing or turning "on", the promoter, which in turn allows the gene that, confers male fertility to be transcribed.

(A) Introduction of a deacetylase gene under the control of a tapetum-specific promoter and with the application of the chemical N-Ac-PPT (WO 2001/29237).

(B) Introduction of various stamen-specific promoters (WO 1992/13956, WO 1992/13957).

(C) Introduction of the barnase and the barstar gene (Paul, et al., (1992) *Plant Mol. Biol.* 19:611-622).

For additional examples of nuclear male and female sterility systems and genes, see also, U.S. Pat. Nos. 5,859,341; 6,297,426; 5,478,369; 5,824,524; 5,850,014 and 6,265,640, all of which are hereby incorporated by reference.

5. Genes that Create a Site for Site Specific DNA Integration.

This includes the introduction of FRT sites that may be used in the FLP/FRT system and/or Lox sites that may be used in the Cre/Loxp system. For example, see, Lyznik, et al., (2003) *Plant Cell Rep* 21:925-932 and WO 1999/25821, which are hereby incorporated by reference. Other systems that may be used include the Gin recombinase of phage Mu (Maeser, et al., (1991) Vicki Chandler, The Maize Handbook ch. 118 (Springer-Verlag 1994), the Pin recombinase of *E. coli* (Enomoto, et al., 1983) and the R/RS system of the pSRi plasmid (Araki, et al., 1992).

6. Genes that Affect Abiotic Stress Resistance

Including but not limited to flowering, ear and seed development, enhancement of nitrogen utilization efficiency, altered nitrogen responsiveness, drought resistance or tolerance, cold resistance or tolerance and salt resistance or tolerance and increased yield under stress.

(A) For example, see: WO 2000/73475 where water use efficiency is altered through alteration of malate; U.S. Pat. Nos. 5,892,009, 5,965,705, 5,929,305, 5,891,859, 6,417,428, 6,664,446, 6,706,866, 6,717,034, 6,801,104, WO 2000/060089, WO 2001/026459, WO 2001/035725, WO 2001/034726, WO 2001/035727, WO 2001/036444, WO 2001/036597, WO 2001/036598, WO 2002/015675, WO 2002/017430, WO 2002/077185, WO 2002/079403, WO 2003/013227, WO 2003/013228, WO 2003/014327, WO 2004/031349, WO 2004/076638, WO 199809521.

(B) WO 199938977 describing genes, including CBF genes and transcription factors effective in mitigating the negative effects of freezing, high salinity and drought on plants, as well as conferring other positive effects on plant phenotype.

(C) US Patent Application Publication Number 2004/0148654 and WO 2001/36596 where abscisic acid is altered in plants resulting in improved plant phenotype such as increased yield and/or increased tolerance to abiotic stress.

(D) WO 2000/006341, WO 2004/090143, U.S. Pat. Nos. 7,531,723 and 6,992,237 where cytokinin expression is modified resulting in plants with increased stress tolerance, such as drought tolerance, and/or increased yield. Also see, WO 2002/02776, WO 2003/052063, JP 2002/281975, U.S. Pat. No. 6,084,153, WO 2001/64898, U.S. Pat. Nos. 6,177,275 and 6,107,547 (enhancement of nitrogen utilization and altered nitrogen responsiveness).

(E) For ethylene alteration, see US Patent Application Publication Number 2004/0128719, US Patent Application Publication Number 2003/0166197 and WO 2000/32761.

(F) For plant transcription factors or transcriptional regulators of abiotic stress, see, e.g., US Patent Application Publication Number 2004/0098764 or US Patent Application Publication Number 2004/0078852.

(G) Genes that increase expression of vacuolar pyrophosphatase such as AVP1 (U.S. Pat. No. 8,058,515) for increased yield; nucleic acid encoding a HSFA4 or a HSFA5 (Heat Shock Factor of the class A4 or A5) polypeptides, an oligopeptide transporter protein (OPT4-like) polypeptide; a plastochron2-like (PLA2-like) polypeptide or a Wuschel related homeobox 1-like (WOX1-like) polypeptide (U. Patent Application Publication Number US 2011/0283420).

(H) Down regulation of polynucleotides encoding poly (ADP-ribose) polymerase (PARP) proteins to modulate programmed cell death (U.S. Pat. No. 8,058,510) for increased vigor.

(I) Polynucleotide encoding DTP21 polypeptides for conferring drought resistance (US Patent Application Publication Number US 2011/0277181).

(J) Nucleotide sequences encoding ACC Synthase 3 (ACS3) proteins for modulating development, modulating response to stress, and modulating stress tolerance (US Patent Application Publication Number US 2010/0287669).

(K) Polynucleotides that encode proteins that confer a drought tolerance phenotype (DTP) for conferring drought resistance (WO 2012/058528).

(L) Tocopherol cyclase (TC) genes for conferring drought and salt tolerance (US Patent Application Publication Number 2012/0272352).

(M) CAAX amino terminal family proteins for stress tolerance (U.S. Pat. No. 8,338,661).

(N) Mutations in the SAL1 encoding gene have increased stress tolerance, including increased drought resistant (US Patent Application Publication Number 2010/0257633).

(O) Expression of a nucleic acid sequence encoding a polypeptide selected from the group consisting of: GRF polypeptide, RAA1-like polypeptide, SYR polypeptide, ARKL polypeptide, and YTP polypeptide increasing yield-related traits (US Patent Application Publication Number 2011/0061133).

(P) Modulating expression in a plant of a nucleic acid encoding a Class III Trehalose Phosphate Phosphatase (TPP) polypeptide for enhancing yield-related traits in plants, particularly increasing seed yield (US Patent Application Publication Number 2010/0024067).

Other genes and transcription factors that affect plant growth and agronomic traits such as yield, flowering, plant growth and/or plant structure, can be introduced or introgressed into plants, see e.g., WO 1997/49811 (LHY), WO 1998/56918 (ESD4), WO 1997/10339 and U.S. Pat. No. 6,573,430 (TFL), U.S. Pat. No. 6,713,663 (FT), WO 1996/14414 (CON), WO 1996/38560, WO 2001/21822 (VRN1), WO 2000/44918 (VRN2), WO 1999/49064 (GI), WO 2000/46358 (FR1), WO 1997/29123, U.S. Pat. Nos. 6,794,560, 6,307,126 (GAI), WO 1999/09174 (D8 and Rht) and WO 2004/076638 and WO 2004/031349 (transcription factors).

7. Genes that Confer Increased Yield (A) A transgenic crop plant transformed by a 1-Amino-Cyclopropane-1-Carboxylate Deaminase-like Polypeptide (ACCDP) coding nucleic acid, wherein expression of the nucleic acid sequence in the crop plant results in the plant's increased root growth, and/or increased yield, and/or increased tolerance to environmental stress as compared to a wild type variety of the plant (U.S. Pat. No. 8,097,769).

(B) Over-expression of maize zinc finger protein gene (Zm-ZFP1) using a seed preferred promoter has been shown to enhance plant growth, increase kernel number and total kernel weight per plant (US Patent Application Publication Number 2012/0079623).

(C) Constitutive over-expression of maize lateral organ boundaries (LOB) domain protein (Zm-LOBDP1) has been shown to increase kernel number and total kernel weight per plant (US Patent Application Publication Number 2012/0079622).

(D) Enhancing yield-related traits in plants by modulating expression in a plant of a nucleic acid encoding a VIM1 (Variant in Methylation 1)-like polypeptide or a VTC2-like (GDP-L-galactose phosphorylase) polypeptide or a DUF1685 polypeptide or an ARF6-like (Auxin Responsive Factor) polypeptide (WO 2012/038893).

(E) Modulating expression in a plant of a nucleic acid encoding a Ste20-like polypeptide or a homologue thereof gives plants having increased yield relative to control plants (EP 2431472).

(F) Genes encoding nucleoside diphosphatase kinase (NDK) polypeptides and homologs thereof for modifying the plant's root architecture (US Patent Application Publication Number 2009/0064373).

8. Genes that Confer Plant Digestibility.

(A) Altering the level of xylan present in the cell wall of a plant by modulating expression of xylan synthase (U.S. Pat. No. 8,173,866).

In some embodiment the stacked trait may be a trait or event that has received regulatory approval including but not limited to the events with regulatory approval that are well known to one skilled in the art and can be found at the Center for Environmental Risk Assessment (cera-gmc.org/?action=gm_crop_database, which can be accessed using the www prefix) and at the International Service for the Acquisition of Agri-Biotech Applications (isaaa.org/gmapprovaldatabase/default.asp, which can be accessed using the www prefix).

Gene Silencing

In some embodiments, the stacked trait may be in the form of silencing of one or more polynucleotides of interest resulting in suppression of one or more target pest polypeptides. In some embodiments, the silencing is achieved using a suppression DNA construct.

In some embodiments one or more polynucleotide encoding the polypeptides of the IPD080 polypeptide or fragments or variants thereof may be stacked with one or more polynucleotides encoding one or more polypeptides having insecticidal activity or agronomic traits as set forth supra and optionally may further include one or more polynucleotides providing for gene silencing of one or more target polynucleotides as discussed infra.

"Suppression DNA construct" is a recombinant DNA construct which when transformed or stably integrated into the genome of the plant, results in "silencing" of a target gene in the plant. The target gene may be endogenous or transgenic to the plant. "Silencing," as used herein with respect to the target gene, refers generally to the suppression of levels of mRNA or protein/enzyme expressed by the target gene, and/or the level of the enzyme activity or protein functionality. The term "suppression" includes lower, reduce, decline, decrease, inhibit, eliminate and prevent. "Silencing" or "gene silencing" does not specify mechanism and is inclusive, and not limited to, anti-sense, cosuppression, viral-suppression, hairpin suppression, stem-loop suppression, RNAi-based approaches and small RNA-based approaches.

A suppression DNA construct may comprise a region derived from a target gene of interest and may comprise all or part of the nucleic acid sequence of the sense strand (or antisense strand) of the target gene of interest. Depending upon the approach to be utilized, the region may be 100% identical or less than 100% identical (e.g., at least 50% or any integer between 51% and 100% identical) to all or part of the sense strand (or antisense strand) of the gene of interest.

Suppression DNA constructs are well-known in the art, are readily constructed once the target gene of interest is selected, and include, without limitation, cosuppression constructs, antisense constructs, viral-suppression constructs, hairpin suppression constructs, stem-loop suppression constructs, double-stranded RNA-producing constructs, and more generally, RNAi (RNA interference) constructs and small RNA constructs such as siRNA (short interfering RNA) constructs and miRNA (microRNA) constructs.

"Antisense inhibition" refers to the production of antisense RNA transcripts capable of suppressing the expression of the target protein.

"Antisense RNA" refers to an RNA transcript that is complementary to all or part of a target primary transcript or mRNA and that blocks the expression of a target isolated nucleic acid fragment. The complementarity of an antisense RNA may be with any part of the specific gene transcript, i.e., at the 5' non-coding sequence, 3' non-coding sequence, introns or the coding sequence.

"Cosuppression" refers to the production of sense RNA transcripts capable of suppressing the expression of the target protein. "Sense" RNA refers to RNA transcript that includes the mRNA and can be translated into protein within a cell or in vitro. Cosuppression constructs in plants have been previously designed by focusing on overexpression of a nucleic acid sequence having homology to a native mRNA, in the sense orientation, which results in the reduction of all RNA having homology to the overexpressed sequence (see, Vaucheret, et al., (1998) Plant J. 16:651-659 and Gura, (2000) Nature 404:804-808).

Another variation describes the use of plant viral sequences to direct the suppression of proximal mRNA encoding sequences (PCT Publication WO 1998/36083).

Recent work has described the use of "hairpin" structures that incorporate all or part, of an mRNA encoding sequence in a complementary orientation that results in a potential "stem-loop" structure for the expressed RNA (PCT Publication WO 1999/53050). In this case the stem is formed by polynucleotides corresponding to the gene of interest inserted in either sense or anti-sense orientation with respect to the promoter and the loop is formed by some polynucleotides of the gene of interest, which do not have a complement in the construct. This increases the frequency of cosuppression or silencing in the recovered transgenic plants. For review of hairpin suppression, see, Wesley, et al., (2003) Methods in Molecular Biology, Plant Functional Genomics: Methods and Protocols 236:273-286.

A construct where the stem is formed by at least 30 nucleotides from a gene to be suppressed and the loop is formed by a random nucleotide sequence has also effectively been used for suppression (PCT Publication WO 1999/61632).

The use of poly-T and poly-A sequences to generate the stem in the stem-loop structure has also been described (PCT Publication WO 2002/00894).

Yet another variation includes using synthetic repeats to promote formation of a stem in the stem-loop structure. Transgenic organisms prepared with such recombinant DNA fragments have been shown to have reduced levels of the protein encoded by the nucleotide fragment forming the loop as described in PCT Publication WO 2002/00904.

RNA interference refers to the process of sequence-specific post-transcriptional gene silencing in animals mediated by short interfering RNAs (siRNAs) (Fire, et al., (1998) Nature 391:806). The corresponding process in plants is commonly referred to as post-transcriptional gene silencing (PTGS) or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla (Fire, et al., (1999) Trends Genet. 15:358). Such protection from foreign gene expression may have evolved in response to the production of double-stranded RNAs (dsRNAs) derived from viral infection or from the random integration of transposon elements into a host genome via a cellular response that specifically destroys homologous single-stranded RNA of viral genomic RNA. The presence of dsRNA in cells triggers the RNAi response through a mechanism that has yet to be fully characterized.

The presence of long dsRNAs in cells stimulates the activity of a ribonuclease III enzyme referred to as dicer. Dicer is involved in the processing of the dsRNA into short pieces of dsRNA known as short interfering RNAs (siRNAs) (Berstein, et al., (2001) Nature 409:363). Short interfering RNAs derived from dicer activity are typically about 21 to about 23 nucleotides in length and comprise about 19 base pair duplexes (Elbashir, et al., (2001) Genes Dev. 15:188). Dicer has also been implicated in the excision of 21- and 22-nucleotide small temporal RNAs (stRNAs) from precursor RNA of conserved structure that are implicated in translational control (Hutvagner, et al., (2001) Science 293: 834). The RNAi response also features an endonuclease complex, commonly referred to as an RNA-induced silencing complex (RISC), which mediates cleavage of single-stranded RNA having sequence complementarity to the antisense strand of the siRNA duplex. Cleavage of the target RNA takes place in the middle of the region complementary to the antisense strand of the siRNA duplex (Elbashir, et al., (2001) Genes Dev. 15:188). In addition, RNA interference can also involve small RNA (e.g., miRNA) mediated gene silencing, presumably through cellular mechanisms that regulate chromatin structure and thereby prevent transcription of target gene sequences (see, e.g., Allshire, (2002) Science 297:1818-1819; Volpe, et al., (2002) Science 297: 1833-1837; Jenuwein, (2002) Science 297:2215-2218 and Hall, et al., (2002) Science 297:2232-2237). As such, miRNA molecules of the disclosure can be used to mediate gene silencing via interaction with RNA transcripts or alternately by interaction with particular gene sequences, wherein such interaction results in gene silencing either at the transcriptional or post-transcriptional level.

Methods and compositions are further provided which allow for an increase in RNAi produced from the silencing element. In such embodiments, the methods and compositions employ a first polynucleotide comprising a silencing element for a target pest sequence operably linked to a promoter active in the plant cell; and, a second polynucleotide comprising a suppressor enhancer element comprising the target pest sequence or an active variant or fragment thereof operably linked to a promoter active in the plant cell. The combined expression of the silencing element with suppressor enhancer element leads to an increased amplification of the inhibitory RNA produced from the silencing element over that achievable with only the expression of the silencing element alone. In addition to the increased amplification of the specific RNAi species itself, the methods and compositions further allow for the production of a diverse population of RNAi species that can enhance the effectiveness of disrupting target gene expression. As such, when the suppressor enhancer element is expressed in a plant cell in combination with the silencing element, the methods and composition can allow for the systemic production of RNAi throughout the plant; the production of greater amounts of RNAi than would be observed with just the silencing element construct alone; and, the improved loading of RNAi into the phloem of the plant, thus providing better control of phloem feeding insects by an RNAi approach. Thus, the various methods and compositions provide improved methods for the delivery of inhibitory RNA to the target organism. See, for example, US Patent Application Publication 2009/0188008.

As used herein, a "suppressor enhancer element" comprises a polynucleotide comprising the target sequence to be suppressed or an active fragment or variant thereof. It is recognized that the suppressor enhancer element need not be identical to the target sequence, but rather, the suppressor enhancer element can comprise a variant of the target sequence, so long as the suppressor enhancer element has sufficient sequence identity to the target sequence to allow for an increased level of the RNAi produced by the silencing element over that achievable with only the expression of the silencing element. Similarly, the suppressor enhancer element can comprise a fragment of the target sequence, wherein the fragment is of sufficient length to allow for an increased level of the RNAi produced by the silencing element over that achievable with only the expression of the silencing element.

It is recognized that multiple suppressor enhancer elements from the same target sequence or from different target sequences or from different regions of the same target sequence can be employed. For example, the suppressor enhancer elements employed can comprise fragments of the target sequence derived from different region of the target sequence (i.e., from the 3'UTR, coding sequence, intron, and/or 5'UTR). Further, the suppressor enhancer element can be contained in an expression cassette, as described elsewhere herein, and in specific embodiments, the suppressor enhancer element is on the same or on a different DNA vector or construct as the silencing element. The suppressor enhancer element can be operably linked to a promoter as disclosed herein. It is recognized that the suppressor enhancer element can be expressed constitutively or alternatively, it may be produced in a stage-specific manner employing the various inducible or tissue-preferred or developmentally regulated promoters that are discussed elsewhere herein.

In specific embodiments, employing both a silencing element and the suppressor enhancer element the systemic production of RNAi occurs throughout the entire plant. In further embodiments, the plant or plant parts of the disclosure have an improved loading of RNAi into the phloem of the plant than would be observed with the expression of the silencing element construct alone and, thus provide better control of phloem feeding insects by an RNAi approach. In specific embodiments, the plants, plant parts and plant cells of the disclosure can further be characterized as allowing for the production of a diversity of RNAi species that can enhance the effectiveness of disrupting target gene expression.

In specific embodiments, the combined expression of the silencing element and the suppressor enhancer element increases the concentration of the inhibitory RNA in the plant cell, plant, plant part, plant tissue or phloem over the level that is achieved when the silencing element is expressed alone.

As used herein, an "increased level of inhibitory RNA" comprises any statistically significant increase in the level of RNAi produced in a plant having the combined expression when compared to an appropriate control plant. For example, an increase in the level of RNAi in the plant, plant part or the plant cell can comprise at least about a 1%, about a 1%-5%, about a 5%-10%, about a 10%-20%, about a 20%-30%, about a 30%-40%, about a 40%-50%, about a 50%-60%, about 60-70%, about 70%-80%, about a 80%-90%, about a 90%-100% or greater increase in the level of RNAi in the plant, plant part, plant cell or phloem when compared to an appropriate control. In other embodiments, the increase in the level of RNAi in the plant, plant part, plant cell or phloem can comprise at least about a 1 fold, about a 1 fold-5 fold, about a 5 fold-10 fold, about a 10 fold-20 fold, about a 20 fold-30 fold, about a 30 fold-40 fold, about a 40 fold-50 fold, about a 50 fold-60 fold, about 60 fold-70 fold, about 70 fold-80 fold, about a 80 fold-90 fold, about a 90 fold-100 fold or greater increase in the level of RNAi in the plant, plant part, plant cell or phloem when compared to an appropriate control. Examples of combined expression of the silencing element with suppressor enhancer element for the control of Stinkbugs and Lygus can be found in US Patent Application Publication 2011/0301223 and US Patent Application Publication 2009/0192117.

Some embodiments relate to down-regulation of expression of target genes in insect pest species by interfering ribonucleic acid (RNA) molecules. PCT Publication WO 2007/074405 describes methods of inhibiting expression of target genes in invertebrate pests including Colorado potato beetle. PCT Publication WO 2005/110068 describes methods of inhibiting expression of target genes in invertebrate pests including Western corn rootworm to control insect infestation. Furthermore, PCT Publication WO 2009/091864 describes compositions and methods for the suppression of target genes from insect pest species including pests from the Lygus genus. Nucleic acid molecules including RNAi for targeting the vacuolar ATPase H subunit, useful for controlling a coleopteran pest population and infestation as described in US Patent Application Publication 2012/0198586. PCT Publication WO 2012/055982 describes ribonucleic acid (RNA or double stranded RNA) that inhibits or down regulates the expression of a target gene that encodes: an insect ribosomal protein such as the ribosomal protein L19, the ribosomal protein L40 or the ribosomal protein S27A; an insect proteasome subunit such as the Rpn6 protein, the Pros 25, the Rpn2 protein, the proteasome beta 1 subunit protein or the Pros beta 2 protein; an insect β-coatomer of the COPI vesicle, the γ-coatomer of the COPI vesicle, the β'-coatomer protein or the ξ-coatomer of the COPI vesicle; an insect Tetraspanine 2 Å protein which is a putative transmembrane domain protein; an insect protein belonging to the actin family such as Actin 5C; an insect ubiquitin-5E protein; an insect Sec23 protein which is a GTPase activator involved in intracellular protein transport; an insect crinkled protein which is an unconventional myosin which is involved in motor activity; an insect crooked neck protein which is involved in the regulation of nuclear alternative mRNA splicing; an insect vacuolar H+-ATPase G-subunit protein and an insect Tbp-1 such as Tat-binding protein. PCT publication WO 2007/035650 describes ribonucleic acid (RNA or double stranded RNA) that inhibits or down regulates the expression of a target gene that encodes Snf7. US Patent Application publication 2011/0054007 describes polynucleotide silencing elements targeting RPS10. US Patent Application publications 2014/0275208 and US2015/0257389 describe polynucleotide silencing elements targeting RyanR and PATS. PCT Patent Application publication WO2016/138106 describes polynucleotide silencing elements targeting coatomer alpha or gamma. US Patent Application Publications 2012/029750, US 20120297501, and 2012/0322660 describe interfering ribonucleic acids (RNA or double stranded RNA) that functions upon uptake by an insect pest species to down-regulate expression of a target gene in said insect pest, wherein the RNA comprises at least one silencing element wherein the silencing element is a region of double-stranded RNA comprising annealed complementary strands, one strand of which comprises or consists of a sequence of nucleotides which is at least partially complementary to a target nucleotide sequence within the target gene. US Patent Application Publication 2012/0164205 describe potential targets for interfering double stranded ribonucleic acids for inhibiting invertebrate pests including: a Chd3 Homologous Sequence, a Beta-Tubulin Homologous Sequence, a 40 kDa V-ATPase Homologous Sequence, a EF1a Homologous Sequence, a 26S Proteosome Subunit p28 Homologous Sequence, a Juvenile Hormone Epoxide Hydrolase Homologous Sequence, a Swelling Dependent Chloride Channel Protein Homologous Sequence, a Glucose-6-Phosphate 1-Dehydrogenase Protein Homologous Sequence, an Act42A Protein Homologous Sequence, a ADP-Ribosylation Factor 1 Homologous Sequence, a Transcription Factor IIB Protein Homologous Sequence, a Chitinase Homologous Sequences, a Ubiquitin Conjugating Enzyme Homologous Sequence, a Glyceraldehyde-3-Phosphate Dehydrogenase Homologous Sequence, an Ubiquitin B Homologous Sequence, a Juvenile Hormone Esterase Homolog, and an Alpha Tubuliln Homologous Sequence.

Use in Pesticidal Control

General methods for employing strains comprising a nucleic acid sequence of the embodiments or a variant thereof, in pesticide control or in engineering other organisms as pesticidal agents are known in the art.

Microorganism hosts that are known to occupy the "phytosphere" (phylloplane, phyllosphere, rhizosphere, and/or rhizoplana) of one or more crops of interest may be selected. These microorganisms are selected to be capable of successfully competing in the particular environment with the wild-type microorganisms, provide for stable maintenance and expression of the gene expressing the IPD080 polypeptide and desirably provide for improved protection of the pesticide from environmental degradation and inactivation.

Alternatively, the IPD080 polypeptide is produced by introducing a heterologous gene into a cellular host. Expression of the heterologous gene results, directly or indirectly, in the intracellular production and maintenance of the pesticide. These cells are then treated under conditions that prolong the activity of the toxin produced in the cell when the cell is applied to the environment of target pest(s). The resulting product retains the toxicity of the toxin. These naturally encapsulated IPD080 polypeptides may then be formulated in accordance with conventional techniques for application to the environment hosting a target pest, e.g., soil, water, and foliage of plants. See, for example EPA 0192319, and the references cited therein.

Pesticidal Compositions

In some embodiments, the active ingredients can be applied in the form of compositions and can be applied to the crop area or plant to be treated, simultaneously or in succession, with other compounds. These compounds can be fertilizers, weed killers, Cryoprotectants, surfactants, detergents, pesticidal soaps, dormant oils, polymers, and/or time-release or biodegradable carrier formulations that permit long-term dosing of a target area following a single application of the formulation. They can also be selective herbicides, chemical insecticides, virucides, microbicides, amoebicides, pesticides, fungicides, bacteriocides, nematocides, molluscicides or mixtures of several of these preparations, if desired, together with further agriculturally acceptable carriers, surfactants or application-promoting adjuvants customarily employed in the art of formulation. Suitable carriers and adjuvants can be solid or liquid and correspond to the substances ordinarily employed in formulation technology, e.g. natural or regenerated mineral substances, solvents, dispersants, wetting agents, tackifiers, binders or fertilizers. Likewise, the formulations may be prepared into edible "baits" or fashioned into pest "traps" to permit feeding or ingestion by a target pest of the pesticidal formulation.

Methods of applying an active ingredient or an agrochemical composition that contains at least one of the IPD080 polypeptide produced by the bacterial strains include leaf application, seed coating and soil application. The number of applications and the rate of application depend on the intensity of infestation by the corresponding pest.

The composition may be formulated as a powder, dust, pellet, granule, spray, emulsion, colloid, solution or such like, and may be prepared by such conventional means as desiccation, lyophilization, homogenation, extraction, filtration, centrifugation, sedimentation or concentration of a culture of cells comprising the polypeptide. In all such compositions that contain at least one such pesticidal polypeptide, the polypeptide may be present in a concentration of from about 1% to about 99% by weight.

Lepidopteran, Dipteran, Heteropteran, nematode, Hemiptera or Coleopteran pests may be killed or reduced in numbers in each area by the methods of the disclosure or may be prophylactically applied to an environmental area to prevent infestation by a susceptible pest. Preferably the pest ingests or is contacted with, a pesticidally-effective amount of the polypeptide. "Pesticidally-effective amount" as used herein refers to an amount of the pesticide that can bring about death to at least one pest or to noticeably reduce pest growth, feeding or normal physiological development. This amount will vary depending on such factors as, for example, the specific target pests to be controlled, the specific environment, location, plant, crop or agricultural site to be treated, the environmental conditions and the method, rate, concentration, stability, and quantity of application of the pesticidally-effective polypeptide composition. The formulations may also vary with respect to climatic conditions, environmental considerations, and/or frequency of application and/or severity of pest infestation.

The pesticide compositions described may be made by formulating the bacterial cell, Crystal and/or spore suspension or isolated protein component with the desired agriculturally-acceptable carrier. The compositions may be formulated prior to administration in an appropriate means such as lyophilized, freeze-dried, desiccated or in an aqueous carrier, medium or suitable diluent, such as saline or another buffer. The formulated compositions may be in the form of a dust or granular material or a suspension in oil (vegetable or mineral) or water or oil/water emulsions or as a wettable powder or in combination with any other carrier material suitable for agricultural application. Suitable agricultural carriers can be solid or liquid and are well known in the art. The term "agriculturally-acceptable carrier" covers all adjuvants, inert components, dispersants, surfactants, tackifiers, binders, etc. that are ordinarily used in pesticide formulation technology; these are well known to those skilled in pesticide formulation. The formulations may be mixed with one or more solid or liquid adjuvants and prepared by various means, e.g., by homogeneously mixing, blending and/or grinding the pesticidal composition with suitable adjuvants using conventional formulation techniques. Suitable formulations and application methods are described in U.S. Pat. No. 6,468,523, herein incorporated by reference. The plants can also be treated with one or more chemical compositions, including one or more herbicide, insecticides or fungicides.

Exemplary chemical compositions include: Fruits/Vegetables Herbicides: Atrazine, Bromacil, Diuron, Glyphosate, Linuron, Metribuzin, Simazine, Trifluralin, Fluazifop, Glufosinate, Halo sulfuron Gowan, Paraquat, Propyzamide, Sethoxydim, Butafenacil, Halosulfuron, Indaziflam; Fruits/Vegetables Insecticides: Aldicarb, Bacillus thuriengiensis, Carbaryl, Carbofuran, Chlorpyrifos, Cypermethrin, Deltamethrin, Diazinon, Malathion, Abamectin, Cyfluthrin/beta-cyfluthrin, Esfenvalerate, Lambda-cyhalothrin, Acequinocyl, Bifenazate, Methoxyfenozide, Novaluron, Chromafenozide, Thiacloprid, Dinotefuran, FluaCrypyrim, Tolfenpyrad, Clothianidin, Spirodiclofen, Gamma-cyhalothrin, Spiromesifen, Spinosad, Rynaxypyr, Cyazypyr, Spinoteram, Triflumuron, Spirotetramat, Imidacloprid, Flubendiamide, Thiodicarb, Metaflumizone, Sulfoxaflor, Cyflumetofen, Cyanopyrafen, Imidacloprid, Clothianidin, Thiamethoxam, Spinotoram, Thiodicarb, Flonicamid, Methiocarb, Emamectin-benzoate, Indoxacarb, Forthiazate, Fenamiphos, Cadusaphos, Pyriproxifen, Fenbutatin-oxid, Hexthiazox, Methomyl, 4-[[(6-Chlorpyridin-3-yl)methyl](2, 2-difluorethyl)amino]furan-2(5H)-on; Fruits/Vegetables Fungicides: Carbendazim, Chlorothalonil, EBDCs, Sulphur, Thiophanate-methyl, Azoxystrobin, Cymoxanil, Fluazinam, Fosetyl, Iprodione, Kresoxim-methyl, Metalaxyl/mefenoxam, Trifloxystrobin, Ethaboxam, Iprovalicarb, Trifloxystrobin, Fenhexamid, Oxpoconazole fumarate, Cyazofamid, Fenamidone, Zoxamide, Picoxystrobin, Pyraclostrobin, Cyflufenamid, Boscalid; Cereals Herbicides: Isoproturon, Bromoxynil, Ioxynil, Phenoxies, Chlorsulfuron, Clodinafop, Diclofop, Diflufenican, Fenoxaprop, Florasulam, Fluoroxypyr, Metsulfuron, Triasulfuron, Flucarbazone, lodosulfuron, Propoxycarbazone, Picolinafen, Mesosulfuron, Beflubutamid, Pinoxaden, Amidosulfuron, Thifensulfuron Methyl, Tribenuron, Flupyrsulfuron, Sulfosulfuron, Pyrasulfotole, Pyroxsulam, Flufenacet, Tralkoxydim, Pyroxasulfon; Cereals Fungicides: Carbendazim, Chlorothalonil, Azoxystrobin, Cyproconazole, Cyprodinil, Fenpropimorph, Epoxiconazole, Kresoxim-methyl, Quinoxyfen, Tebuconazole, Trifloxystrobin, Simeconazole, Picoxystrobin, Pyraclostrobin, Dimoxystrobin, Prothioconazole, Fluoxastrobin; Cereals Insecticides: Dimethoate, Lambda-cyhalthrin, Deltamethrin, alpha-Cypermethrin, β-cyfluthrin, Bifenthrin, Imidacloprid, Clothianidin, Thiamethoxam, Thiacloprid, Acetamiprid, Dinetofuran, Clorphyriphos, Metamidophos, Oxidemethonmethyl, Pirimicarb, Methiocarb; Maize Herbicides: Atrazine, Alachlor, Bromoxynil, Acetochlor, Dicamba, Clopyralid, (S-) Dimethenamid, Glufosinate, Glyphosate, Isoxaflutole, (S-)Metolachlor, Mesotrione, Nicosulfuron, Primisulfuron, Rimsulfuron, Sulcotrione, Foramsulfuron, Topramezone, Tembotrione, Saflufenacil, Thiencarbazone, Flufenacet, Pyroxasulfon; Maize Insecticides: Carbofuran, Chlorpyrifos, Bifenthrin, Fipronil, Imidacloprid, Lambda-Cyhalothrin, Tefluthrin, Terbufos, Thiamethoxam, Clothianidin, Spiromesifen, Flubendiamide, Triflumuron, Rynaxypyr, Deltamethrin, Thiodicarb, β-Cyfluthrin, Cypermethrin, Bifenthrin, Lufenuron, Triflumoron, Tefluthrin, Tebupirimphos, Ethiprole, Cyazypyr, Thiacloprid, Acetamiprid, Dinetofuran, Avermectin, Methiocarb, Spirodiclofen, Spirotetramat; Maize Fungicides: Fenitropan, Thiram, Prothioconazole, Tebuconazole, Trifloxystrobin; Rice Herbicides: Butachlor, Propanil, Azimsulfuron, Bensulfuron, Cyhalofop, Daimuron, Fentrazamide, Imazosulfuron, Mefenacet, Oxaziclomefone, Pyrazosulfuron, Pyributicarb, Quinclorac, Thiobencarb, Indanofan, Flufenacet, Fentrazamide, Halosulfuron, Oxaziclomefone, Benzobicyclon, Pyriftalid, Penoxsulam, Bispyribac, Oxadiargyl, Ethoxysulfuron, Pretilachlor, Mesotrione, Tefuryltrione, Oxadiazone, Fenoxaprop, Pyrimisulfan; Rice Insecticides: Diazinon, Fenitrothion, Fenobucarb, Monocrotophos, Benfuracarb, Buprofezin, Dinotefuran, Fipronil, Imidacloprid, Isoprocarb, Thiacloprid, Chromafenozide, Thiacloprid, Dinotefuran, Clothianidin, Ethiprole, Flubendiamide, Rynaxypyr, Deltamethrin, Acetamiprid, Thiamethoxam, Cyazypyr, Spinosad, Spinotoram, Emamectin-Benzoate, Cypermethrin, Chlorpyriphos, Cartap, Methamidophos, Etofenprox, Triazophos, 4-[[(6-Chlorpyridin-3-yl)methyl](2,2-difluorethyl)amino]furan-2(5H)-on, Carbofuran, Benfuracarb; Rice Fungicides: Thiophanate-methyl, Azoxystrobin, Carpropamid, Edifenphos, Ferimzone, Iprobenfos, Isoprothiolane, Pencycuron, Probenazole, Pyroquilon, Tricyclazole, Trifloxystrobin, Diclocymet, Fenoxanil, Simeconazole, Tiadinil; Cotton Herbicides: Diuron, Fluometuron, MSMA, Oxyfluorfen, Prometryn, Trifluralin, Carfentrazone, Clethodim, Fluazifop-butyl, Glyphosate, Norflurazon, Pendimethalin, Pyrithiobac-sodium, Trifloxysulfuron, Tepraloxydim, Glufosinate, Flumioxazin, Thidiazuron; Cotton Insecticides: Acephate, Aldicarb, Chlorpyrifos, Cypermethrin, Deltamethrin, Malathion, Monocrotophos, Abamectin, Acetamiprid, Emamectin Benzoate, Imidacloprid, Indoxacarb, Lambda-Cyhalothrin, Spinosad, Thiodicarb, Gamma-Cyhalothrin, Spiromesifen, Pyridalyl, Flonicamid, Flubendiamide, Triflumuron, Rynaxypyr, Beta-Cyfluthrin, Spirotetramat, Clothianidin, Thiamethoxam, Thiacloprid, Dinetofuran, Flubendiamide, Cyazypyr, Spinosad, Spinotoram, gamma Cyhalothrin, 4-[[(6-Chlorpyridin-3-yl)methyl](2,2-difluorethyl)amino]furan-2(5H)-on, Thiodicarb, Avermectin, Flonicamid, Pyridalyl, Spiromesifen, Sulfoxaflor, Profenophos, Thriazophos, Endosulfan; Cotton Fungicides: Etridiazole, Metalaxyl, Quintozene; Soybean Herbicides: Alachlor, Bentazone, Trifluralin, Chlorimuron-Ethyl, Cloransulam-Methyl, Fenoxaprop, Fomesafen, Fluazifop, Glyphosate, Imazamox, Imazaquin, Imazethapyr, (S-) Metolachlor, Metribuzin, Pendimethalin, Tepraloxydim, Glufosinate; Soybean Insecticides: Lambda-cyhalothrin, Methomyl, Parathion, Thiocarb, Imidacloprid, Clothianidin, Thiamethoxam, Thiacloprid, Acetamiprid, Dinetofuran, Flubendiamide, Rynaxypyr, Cyazypyr, Spinosad, Spinotoram, Emamectin-Benzoate, Fipronil, Ethiprole, Deltamethrin, β-Cyfluthrin, gamma and lambda Cyhalothrin, 4-[[(6-Chlorpyridin-3-yl)methyl](2,2-difluorethyl)amino]furan-2(5H)-on, Spirotetramat, Spinodiclofen, Triflumuron, Flonicamid, Thiodicarb, beta-Cyfluthrin; Soybean Fungicides: Azoxystrobin, Cyproconazole, Epoxiconazole, Flutriafol, Pyraclostrobin, Tebuconazole, Trifloxystrobin, Prothioconazole, Tetraconazole; Sugarbeet Herbicides: Chloridazon, Desmedipham, Ethofumesate, Phenmedipham, Triallate, Clopyralid, Fluazifop, Lenacil, Metamitron, Quinmerac, Cycloxydim, Triflusulfuron, Tepraloxydim, Quizalofop; Sugarbeet Insecticides: Imidacloprid, Clothianidin, Thiamethoxam, Thiacloprid, Acetamiprid, Dinetofuran, Deltamethrin, β-Cyfluthrin, gamma/lambda Cyhalothrin, 4-[[(6-Chlorpyridin-3-yl)methyl](2,2-difluorethyl)amino]furan-2(5H)-on, Tefluthrin, Rynaxypyr, Cyaxypyr, Fipronil, Carbofuran; Canola Herbicides: Clopyralid, Diclofop, Fluazifop, Glufosinate, Glyphosate, Metazachlor, Trifluralin Ethametsulfuron, Quinmerac, Quizalofop, Clethodim, Tepraloxydim; Canola Fungicides: Azoxystrobin, Carbendazim, Fludioxonil, Iprodione, Prochloraz, Vinclozolin; Canola Insecticides: Carbofuran organophosphates, Pyrethroids, Thiacloprid, Deltamethrin, Imidacloprid, Clothianidin, Thiamethoxam, Acetamiprid, Dinetofuran, β-Cyfluthrin, gamma and lambda Cyhalothrin, tau-Fluvaleriate, Ethiprole, Spinosad, Spinotoram, Flubendiamide, Rynaxypyr, Cyazypyr, 4-[[(6-Chlorpyridin-3-yl)methyl](2,2-difluorethyl)amino]furan-2(5H)-on.

In some embodiments, the herbicide is Atrazine, Bromacil, Diuron, Chlorsulfuron, Metsulfuron, Thifensulfuron Methyl, Tribenuron, Acetochlor, Dicamba, Isoxaflutole, Nicosulfuron, Rimsulfuron, Pyrithiobac-sodium, Flumioxazin, Chlorimuron-Ethyl, Metribuzin, Quizalofop, S-metolachlor, Hexazinne or combinations thereof.

In some embodiments, the insecticide is Esfenvalerate, Chlorantraniliprole, Methomyl, Indoxacarb, Oxamyl or combinations thereof.

Pesticidal and Insecticidal Activity

"Pest" includes but is not limited to, insects, fungi, bacteria, nematodes, mites, ticks and the like. Insect pests include insects selected from the orders Coleoptera, Diptera, Hymenoptera, Lepidoptera, Mallophaga, Homoptera, Hemiptera Orthroptera, Thysanoptera, Dermaptera, Isoptera, Anoplura, Siphonaptera, Trichoptera, etc., particularly Lepidoptera and Coleoptera.

Those skilled in the art will recognize that not all compounds are equally effective against all pests. Compounds of the embodiments display activity against insect pests, which may include economically important agronomic, forest, greenhouse, nursery ornamentals, food and fiber, public and animal health, domestic and commercial structure, household and stored product pests.

Larvae of the order Lepidoptera include, but are not limited to, armyworms, cutworms, loopers and heliothines in the family Noctuidae *Spodoptera frugiperda* JE Smith (fall armyworm); *S. exigua* Hubner (beet armyworm); *S. litura* Fabricius (tobacco cutworm, cluster caterpillar); *Mamestra configurata* Walker (bertha armyworm); *M. brassicae* Linnaeus (cabbage moth); *Agrotis ipsilon* Hufnagel (black cutworm); *A. orthogonia* Morrison (western cutworm); *A. subterranea* Fabricius (granulate cutworm); *Alabama argillacea* Hubner (cotton leaf worm); *Trichoplusia ni* Hubner (cabbage looper); *Pseudoplusia includens* Walker (soybean looper); *Anticarsia gemmatalis* Hubner (velvetbean caterpillar); *Hypena scabra* Fabricius (green cloverworm); *Heliothis virescens* Fabricius (tobacco budworm); *Pseudaletia unipuncta* Haworth (armyworm); *Athetis mindara* Barnes and Mcdunnough (rough skinned cutworm); *Euxoa messoria* Harris (darksided cutworm); *Earias insulana* Boisduval (spiny bollworm); *E. vittella* Fabricius (spotted bollworm); *Helicoverpa armigera* Hubner (American bollworm); *H. zea* Boddie (corn earworm or cotton bollworm); *Melanchra picta* Harris (zebra caterpillar); *Egira (Xylomyges) curialis* Grote (citrus cutworm); borers, casebearers, webworms, coneworms, and skeletonizers from the family Pyralidae *Ostrinia nubilalis* Hubner (European corn borer); *Amyelois transitella* Walker (naval orangeworm); *Anagasta kuehniella* Zeller (Mediterranean flour moth); *Cadra cautella* Walker (almond moth); *Chilo suppressalis* Walker (rice stem borer); *C. partellus*, (sorghum borer); *Corcyra cephalonica* Stainton (rice moth); *Crambus caliginosellus* Clemens (corn root webworm); *C. teterrellus* Zincken (bluegrass webworm); *Cnaphalocrocis medinalis* Guenée (rice leaf roller); *Desmia funeralis* Hubner (grape leaffolder); *Diaphania hyalinata* Linnaeus (melon worm); *D. nitidalis* Stoll (pickleworm); *Diatraea grandiosella* Dyar (southwestern corn borer), *D. saccharalis* Fabricius (surgarcane borer); *Eoreuma loftini* Dyar (Mexican rice borer); *Ephestia elutella* Hubner (tobacco (cacao) moth); *Galleria mellonella* Linnaeus (greater wax moth); *Herpetogramma licarsisalis* Walker (sod webworm); *Homoeosoma electellum* Hulst (sunflower moth); *Elasmopalpus lignosellus* Zeller (lesser cornstalk borer); *Achroia grisella* Fabricius (lesser wax moth); *Loxostege sticticalis* Linnaeus (beet webworm); *Orthaga thyrisalis* Walker (tea tree web moth); *Maruca testulalis* Geyer (bean pod borer); *Plodia interpunctella* Hubner (Indian meal moth); *Scirpophaga incertulas* Walker (yellow stem borer); Udea rubigalis Guenée (celery leaftier); and leafrollers, budworms, seed worms and fruit worms in the family Tortricidae Acleris gloverana Walsingham (Western blackheaded budworm); *A. variana* Fernald (Eastern blackheaded budworm); *Archips argyrospila* Walker (fruit tree leaf roller); *A. rosana* Linnaeus (European leaf roller); and other *Archips* species, *Adoxophyes orana* Fischer von Rosslerstamm (summer fruit tortrix moth); *Cochylis hospes* Walsingham (banded sunflower moth); *Cydia latiferreana* Walsingham (filbertworm); *C. pomonella* Linnaeus (coding moth); *Platynota flavedana* Clemens (variegated leafroller); *P. stultana* Walsingham (omnivorous leafroller); *Lobesia botrana* Denis & Schiffermuller (European grape vine moth); *Spilonota ocellana* Denis & Schiffermuller (eyespotted bud moth); *Endopiza viteana* Clemens (grape berry moth); *Eupoecilia ambiguella* Hubner (vine moth); *Bonagota salubricola* Meyrick (Brazilian apple leafroller); *Grapholita molesta* Busck (oriental fruit moth); *Suleima helianthana* Riley (sunflower bud moth); *Argyrotaenia* spp.; *Choristoneura* spp.

Selected other agronomic pests in the order Lepidoptera include, but are not limited to, *Alsophila pometaria* Harris (fall cankerworm); *Anarsia lineatella* Zeller (peach twig borer); *Anisota senatoria* J. E. Smith (orange striped oakworm); *Antheraea pernyi* Guerin-Meneville (Chinese Oak Tussah Moth); *Bombyx mori* Linnaeus (Silkworm); *Bucculatrix thurberiella* Busck (cotton leaf perforator); *Collas eurytheme* Boisduval (alfalfa caterpillar); *Datana integerrima* Grote & Robinson (walnut caterpillar); *Dendrolimus sibiricus* Tschetwerikov (Siberian silk moth), *Ennomos subsignaria* Hubner (elm spanworm); *Erannis tiliaria* Harris (linden looper); *Euproctis chrysorrhoea* Linnaeus (browntail moth); *Harrisina americana* Guérin-Meneville (grape-leaf skeletonizer); *Hemileuca oliviae* Cockrell (range caterpillar); *Hyphantria cunea* Drury (fall webworm); *Keiferia lycopersicella* Walsingham (tomato pinworm); *Lambdina fiscellaria fiscellaria* Hulst (Eastern hemlock looper); *L. fiscellaria lugubrosa* Hulst (Western hemlock looper); *Leucoma salicis* Linnaeus (satin moth); *Lymantria dispar* Linnaeus (gypsy moth); *Manduca quinquemaculata* Haworth (five spotted hawk moth, tomato hornworm); *M. sexta* Haworth (tomato hornworm, tobacco hornworm); *Operophtera brumata* Linnaeus (winter moth); *Paleacrita vernata* Peck (spring cankerworm); *Papilio cresphontes* Cramer (giant swallowtail orange dog); *Phryganidia californica* Packard (California oakworm); *Phyllocnistis citrella* Stainton (citrus leafminer); *Phyllonorycter blancardella* Fabricius (spotted tentiform leafminer); *Pieris brassicae* Linnaeus (large white butterfly); *P. rapae* Linnaeus (small white butterfly); *P. napi* Linnaeus (green veined white butterfly); *Platyptilia carduidactyla* Riley (artichoke plume moth); *Plutella xylostella* Linnaeus (diamondback moth); *Pectinophora gossypiella* Saunders (pink bollworm); *Pontia protodice* Boisduval and Leconte (Southern cabbageworm); *Sabulodes aegrotata* Guenee (omnivorous looper); *Schizura concinna* J. E. Smith (red humped caterpillar); *Sitotroga cerealella* Olivier (Angoumois grain moth); *Thaumetopoea pityocampa* Schiffermuller (pine processionary caterpillar); *Tineola bisselliella* Hummel (webbing clothesmoth); *Tuta absoluta* Meyrick (tomato leafminer); *Yponomeuta padella* Linnaeus (ermine moth); *Heliothis subflexa* Guenee; *Malacosoma* spp. and *Orgyia* spp.

Of interest are larvae and adults of the order Coleoptera including weevils from the families Anthribidae, Bruchidae and Curculionidae (including, but not limited to: *Anthonomus grandis* Boheman (boll weevil); *Lissorhoptrus oryzophilus* Kuschel (rice water weevil); *Sitophilus granarius* Linnaeus (granary weevil); *S. oryzae* Linnaeus (rice weevil); *Hypera punctata* Fabricius (clover leaf weevil); *Cylindrocopturus adspersus* LeConte (sunflower stem weevil); *Smicronyx fulvus* LeConte (red sunflower seed weevil); *S. sordidus* LeConte (gray sunflower seed weevil); *Sphenophorus maidis* Chittenden (maize billbug)); flea beetles, cucumber beetles, rootworms, leaf beetles, potato beetles and leafminers in the family Chrysomelidae (including, but not limited to: *Leptinotarsa decemlineata* Say (Colorado potato beetle); *Diabrotica virgifera virgifera* LeConte (western corn rootworm); *D. barberi* Smith and Lawrence (northern corn rootworm); *D. undecimpunctata howardi* Barber (southern corn rootworm); *Chaetocnema pulicaria* Melsheimer (corn flea beetle); *Phyllotreta cruciferae* Goeze (Crucifer flea beetle); *Phyllotreta striolata* (stripped flea beetle); *Colaspis brunnea* Fabricius (grape colaspis); *Oulema melanopus* Linnaeus (cereal leaf beetle); *Zygogramma exclamationis* Fabricius (sunflower beetle)); beetles from the family Coccinellidae (including, but not limited to: *Epilachna varivestis* Mulsant (Mexican bean beetle)); chafers and other beetles from the family Scarabaeidae (including, but not limited to: *Popillia japonica* Newman (Japanese beetle); *Cyclocephala borealis* Arrow (northern masked chafer, white grub); *C. immaculata* Olivier (southern masked chafer, white grub); *Rhizotrogus majalis* Razoumowsky (European chafer); *Phyllophaga crinita* Burmeister (white grub); *Ligyrus gibbosus* De Geer (carrot beetle)); carpet beetles from the family Dermestidae; wireworms from the family Elateridae, *Eleodes* spp., *Melanotus* spp.; *Conoderus* spp.; *Limonius* spp.; *Agriotes* spp.; *Ctenicera* spp.; *Aeolus* spp.; bark beetles from the family Scolytidae and beetles from the family Tenebrionidae.

Adults and immatures of the order Diptera are of interest, including leafminers *Agromyza parvicornis* Loew (corn blotch leafminer); midges (including, but not limited to: *Contarinia sorghicola* Coquillett (sorghum midge); *Mayetiola destructor* Say (Hessian fly); *Sitodiplosis mosellana* Géhin (wheat midge); *Neolasioptera murtfeldtiana* Felt, (sunflower seed midge)); fruit flies (Tephritidae), *Oscinella frit* Linnaeus (fruit flies); maggots (including, but not limited to: *Delia platura* Meigen (seedcorn maggot); *D. coarctata* Fallen (wheat bulb fly) and other *Delia* spp., *Meromyza americana* Fitch (wheat stem maggot); *Musca domestica* Linnaeus (house flies); *Fannia canicularis* Linnaeus, *F. femoralis* Stein (lesser house flies); *Stomoxys calcitrans* Linnaeus (stable flies)); face flies, horn flies, blow flies, *Chrysomya* spp.; *Phormia* spp. and other muscoid fly pests, horse flies *Tabanus* spp.; bot flies *Gastrophilus* spp.; *Oestrus* spp.; cattle grubs *Hypoderma* spp.; deer flies *Chrysops* spp.; *Melophagus ovinus* Linnaeus (keds) and other Brachycera, mosquitoes *Aedes* spp.; *Anopheles* spp.; *Culex* spp.; black flies *Prosimulium* spp.; *Simulium* spp.; biting midges, sand flies, sciarids, and other Nematocera.

Included as insects of interest are adults and nymphs of the orders Hemiptera and Homoptera such as, but not limited to, adelgids from the family Adelgidae, plant bugs from the family Miridae, cicadas from the family Cicadidae, leafhoppers, *Empoasca* spp.; from the family Cicadellidae, planthoppers from the families Cixiidae, Flatidae, Fulgoroidea, Issidae and Delphacidae, treehoppers from the family Membracidae, psyllids from the family Psyllidae, whiteflies from the family Aleyrodidae, aphids from the family Aphididae, phylloxera from the family Phylloxeridae, mealybugs from the family Pseudococcidae, scales from the families Asterolecanidae, Coccidae, Dactylopiidae, Diaspididae, Eriococcidae Ortheziidae, Phoenicococcidae and Margarodidae, lace bugs from the family Tingidae, stink bugs from the family Pentatomidae, cinch bugs, *Blissus* spp.; and other seed bugs from the family Lygaeidae, spittlebugs from the family Cercopidae squash bugs from the family Coreidae and red bugs and cotton stainers from the family Pyrrhocoridae.

Agronomically important members from the order Homoptera further include, but are not limited to: *Acyrthisiphon pisum* Harris (pea aphid); *Aphis craccivora* Koch (cowpea aphid); *A. fabae* Scopoli (black bean aphid); *A. gossypii* Glover (cotton aphid, melon aphid); *A. maidiradicis* Forbes (corn root aphid); *A. pomi* De Geer (apple aphid); *A. spiraecola* Patch (spirea aphid); *Aulacorthum solani* Kaltenbach (foxglove aphid); *Chaetosiphon fragaefolii* Cockerell (strawberry aphid); *Diuraphis noxia* Kurdjumov/Mordvilko (Russian wheat aphid); *Dysaphis plantaginea* Paaserini (rosy apple aphid); *Eriosoma lanigerum* Hausmann (woolly apple aphid); *Brevicoryne brassicae* Linnaeus (cabbage aphid); *Hyalopterus pruni* Geoffroy (mealy plum aphid); *Lipaphis erysimi* Kaltenbach (turnip aphid); *Metopolophium dirrhodum* Walker (cereal aphid); *Macrosiphum euphorbiae* Thomas (potato aphid); *Myzus persicae* Sulzer (peach-potato aphid, green peach aphid); *Nasonovia ribisnigri* Mosley (lettuce aphid); *Pemphigus* spp. (root aphids and gall aphids); *Rhopalosiphum maidis* Fitch (corn leaf aphid); *R. padi* Linnaeus (bird cherry-oat aphid); *Schizaphis graminum* Rondani (greenbug); *Sipha flava* Forbes (yellow sugarcane aphid); *Sitobion avenae* Fabricius (English grain aphid); *Therioaphis maculata* Buckton (spotted alfalfa aphid); *Toxoptera aurantii* Boyer de Fonscolombe (black citrus aphid) and *T. citricida* Kirkaldy (brown citrus aphid); *Adelges* spp. (adelgids); *Phylloxera devastatrix* Pergande (pecan *phylloxera*); *Bemisia tabaci* Gennadius (tobacco whitefly, sweetpotato whitefly); *B. argentifolii* Bellows & Perring (silverleaf whitefly); *Dialeurodes citri* Ashmead (citrus whitefly); *Trialeurodes abutiloneus* (bandedwinged whitefly) and *T. vaporariorum* Westwood (greenhouse whitefly); *Empoasca fabae* Harris (potato leafhopper); *Laodelphax striatellus* Fallen (smaller brown planthopper); *Macrolestes quadrilineatus* Forbes (aster leafhopper); *Nephotettix cinticeps* Uhler (green leafhopper); *N. nigropictus* Stål (rice leafhopper); *Nilaparvata lugens* Stål (brown planthopper); *Peregrinus maidis* Ashmead (corn planthopper); *Sogatella furcifera* Horvath (white-backed planthopper); *Sogatodes orizicola* Muir (rice delphacid); *Typhlocyba pomaria* McAtee (white apple leafhopper); *Erythroneoura* spp. (grape leafhoppers); *Magicicada septendecim* Linnaeus (periodical cicada); *Icerya purchasi* Maskell (cottony cushion scale); *Quadraspidiotus perniciosus* Comstock (San Jose scale); *Planococcus citri* Risso (citrus mealybug); *Pseudococcus* spp. (other mealybug complex); *Cacopsylla pyricola* Foerster (pear psylla); *Trioza diospyri* Ashmead (persimmon psylla).

Agronomically important species of interest from the order Hemiptera include, but are not limited to: *Acrosternum hilare* Say (green stink bug); *Anasa tristis* De Geer (squash bug); *Blissus leucopterus leucopterus* Say (chinch bug); *Corythuca gossypii* Fabricius (cotton lace bug); *Cyrtopeltis modesta* Distant (tomato bug); *Dysdercus suturellus* Herrich-Schaffer (cotton stainer); *Euschistus servus* Say (brown stink bug); *E. variolarius* Palisot de Beauvois (one-spotted stink bug); *Graptostethus* spp. (complex of seed bugs); *Leptoglossus corculus* Say (leaf-footed pine seed bug); *Lygus lineolaris* Palisot de Beauvois (tarnished plant bug); *L. Hesperus* Knight (Western tarnished plant bug); *L. pratensis* Linnaeus (common meadow bug); *L. rugulipennis* Poppius (European tarnished plant bug); *Lygocoris pabulinus* Linnaeus (common green capsid); *Nezara viridula* Linnaeus (southern green stink bug); *Oebalus pugnax* Fabricius (rice stink bug); *Oncopeltus fasciatus* Dallas (large milkweed bug); *Pseudatomoscelis seriatus* Reuter (cotton fleahopper).

Furthermore, embodiments may be effective against Hemiptera such, *Calocoris norvegicus* Gmelin (strawberry bug); *Orthops campestris* Linnaeus; *Plesiocoris rugicollis* Fallen (apple capsid); *Cyrtopeltis modestus* Distant (tomato bug); *Cyrtopeltis notatus* Distant (suckfly); *Spanagonicus albofasciatus* Reuter (whitemarked fleahopper); *Diaphnocoris chlorionis* Say (honeylocust plant bug); *Labopidicola allii* Knight (onion plant bug); *Pseudatomoscelis seriatus* Reuter (cotton fleahopper); *Adelphocoris rapidus* Say (rapid plant bug); *Poecilocapsus lineatus* Fabricius (four-lined plant bug); *Nysius ericae* Schilling (false chinch bug); *Nysius raphanus* Howard (false chinch bug); *Nezara viridula* Linnaeus (Southern green stink bug); *Eurygaster* spp.; *Coreidae* spp.; *Pyrrhocoridae* spp.; *Tinidae* spp.; *Blostomatidae* spp.; *Reduviidae* spp. and *Cimicidae* spp.

Also included are adults and larvae of the order Acari (mites) such as *Aceria tosichella* Keifer (wheat curl mite); *Petrobia latens* Müller (brown wheat mite); spider mites and red mites in the family Tetranychidae, *Panonychus ulmi* Koch (European red mite); *Tetranychus urticae* Koch (two spotted spider mite); (*T. mcdanieli* McGregor (McDaniel mite); *T. cinnabarinus* Boisduval (carmine spider mite); *T. turkestani* Ugarov & Nikolski (strawberry spider mite); flat mites in the family Tenuipalpidae, *Brevipalpus lewisi* McGregor (citrus flat mite); rust and bud mites in the family Eriophyidae and other foliar feeding mites and mites important in human and animal health, i.e., dust mites in the family Epidermoptidae, follicle mites in the family Demodicidae, grain mites in the family Glycyphagidae, ticks in the order Ixodidae. *Ixodes scapularis* Say (deer tick); *I. holocyclus* Neumann (Australian paralysis tick); *Dermacentor variabilis* Say (American dog tick); *Amblyomma americanum* Linnaeus (lone star tick) and scab and itch mites in the families Psoroptidae, Pyemotidae and Sarcoptidae.

Insect pests of the order Thysanura are of interest, such as *Lepisma saccharina* Linnaeus (silverfish); *Thermobia domestica* Packard (firebrat).

Additional arthropod pests covered include: spiders in the order Araneae such as *Loxosceles reclusa* Gertsch and Mulaik (brown recluse spider) and the *Latrodectus mactans* Fabricius (black widow spider) and centipedes in the order Scutigeromorpha such as *Scutigera coleoptrata* Linnaeus (house centipede).

Insect pest of interest include the superfamily of stink bugs and other related insects including but not limited to species belonging to the family Pentatomidae (*Nezara viridula, Halyomorpha halys, Piezodorus guildini, Euschistus servus, Acrosternum hilare, Euschistus heros, Euschistus tristigmus, Acrosternum hilare, Dichelops furcatus, Dichelops melacanthus*, and *Bagrada hilaris* (Bagrada Bug)), the family Plataspidae (*Megacopta cribraria*—Bean plataspid) and the family Cydnidae (*Scaptocoris castanea*—Root stink bug) and Lepidoptera species including but not limited to: diamond-back moth, e.g., *Helicoverpa zea* Boddie; soybean looper, e.g., *Pseudoplusia includens* Walker and velvet bean caterpillar e.g., *Anticarsia gemmatalis* Hubner.

Methods for measuring pesticidal activity are well known in the art. See, for example, Czapla and Lang, (1990) *J.*

Econ. Entomol. 83:2480-2485; Andrews, et al., (1988) Biochem. J. 252:199-206; Marrone, et al., (1985) J. of Economic Entomology 78:290-293 and U.S. Pat. No. 5,743, 477, all of which are herein incorporated by reference in their entirety. Generally, the protein is mixed and used in feeding assays. See, for example Marrone, et al., (1985) J. of Economic Entomology 78:290-293. Such assays can include contacting plants with one or more pests and determining the plant's ability to survive and/or cause the death of the pests.

Nematodes include parasitic nematodes such as root-knot, cyst and lesion nematodes, including *Heterodera* spp., *Meloidogyne* spp. and *Globodera* spp.; particularly members of the cyst nematodes, including, but not limited to, *Heterodera glycines* (soybean cyst nematode); *Heterodera schachtii* (beet cyst nematode); *Heterodera avenae* (cereal cyst nematode) and *Globodera rostochiensis* and *Globodera pailida* (potato cyst nematodes). Lesion nematodes include *Pratylenchus* spp.

Seed Treatment

To protect and to enhance yield production and trait technologies, seed treatment options can provide additional crop plan flexibility and cost effective control against insects, weeds and diseases. Seed material can be treated, typically surface treated, with a composition comprising combinations of chemical or biological herbicides, herbicide safeners, insecticides, fungicides, germination inhibitors and enhancers, nutrients, plant growth regulators and activators, bactericides, nematocides, avicides and/or molluscicides. These compounds are typically formulated together with further carriers, surfactants or application-promoting adjuvants customarily employed in the art of formulation. The coatings may be applied by impregnating propagation material with a liquid formulation or by coating with a combined wet or dry formulation. Examples of the various types of compounds that may be used as seed treatments are provided in The Pesticide Manual: A World Compendium, C. D. S. Tomlin Ed., Published by the British Crop Production Council, which is hereby incorporated by reference.

Some seed treatments that may be used on crop seed include, but are not limited to, one or more of abscisic acid, acibenzolar-S-methyl, avermectin, amitrol, azaconazole, azospirillum, azadirachtin, azoxystrobin, *Bacillus* spp. (including one or more of cereus, firmus, megaterium, pumilis, sphaericus, subtilis and/or thuringiensis species), bradyrhizobium spp. (including one or more of betae, canariense, elkanii, iriomotense, japonicum, liaonigense, pachyrhizi and/or yuanmingense), captan, carboxin, chitosan, clothianidin, copper, cyazypyr, difenoconazole, etidiazole, fipronil, fludioxonil, fluoxastrobin, fluquinconazole, flurazole, fluxofenim, harpin protein, imazalil, imidacloprid, ipconazole, isoflavenoids, lipo-chitooligosaccharide, mancozeb, manganese, maneb, mefenoxam, metalaxyl, metconazole, myclobutanil, PCNB, penflufen, penicillium, penthiopyrad, permethrine, picoxystrobin, prothioconazole, pyraclostrobin, rynaxypyr, S-metolachlor, saponin, sedaxane, TCMTB, tebuconazole, thiabendazole, thiamethoxam, thiocarb, thiram, tolclofos-methyl, triadimenol, trichoderma, trifloxystrobin, triticonazole and/or zinc. PCNB seed coat refers to EPA Registration Number 00293500419, containing quintozen and terrazole. TCMTB refers to 2-(thiocyanomethylthio) benzothiazole.

Seed varieties and seeds with specific transgenic traits may be tested to determine which seed treatment options and application rates may complement such varieties and transgenic traits to enhance yield. For example, a variety with good yield potential but head smut susceptibility may benefit from the use of a seed treatment that provides protection against head smut, a variety with good yield potential but cyst nematode susceptibility may benefit from the use of a seed treatment that provides protection against cyst nematode, and so on. Likewise, a variety encompassing a transgenic trait conferring insect resistance may benefit from the second mode of action conferred by the seed treatment, a variety encompassing a transgenic trait conferring herbicide resistance may benefit from a seed treatment with a safener that enhances the plants resistance to that herbicide, etc. Further, the good root establishment and early emergence that results from the proper use of a seed treatment may result in more efficient nitrogen use, a better ability to withstand drought and an overall increase in yield potential of a variety or varieties containing a certain trait when combined with a seed treatment.

Methods for Killing an Insect Pest and Controlling an Insect Population

In some embodiments methods are provided for killing an insect pest, comprising contacting the insect pest, either simultaneously or sequentially, with an insecticidally-effective amount of a recombinant IPD080 polypeptide or IPD080 chimeric polypeptide of the disclosure. In some embodiments methods are provided for killing an insect pest, comprising contacting the insect pest with an insecticidally-effective amount of a recombinant pesticidal protein of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318 or a variant thereof.

In some embodiments methods are provided for controlling an insect pest population, comprising contacting the insect pest population, either simultaneously or sequentially, with an insecticidally-effective amount of a recombinant IPD080 polypeptide or IPD080 chimeric polypeptide of the disclosure. In some embodiments methods are provided for controlling an insect pest population, comprising contacting the insect pest population with an insecticidally-effective amount of a recombinant IPD080 polypeptide of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318 or a variant thereof. As used herein, "controlling a pest population" or "controls a pest" refers to any effect on a pest that results in limiting the damage that the pest causes. Controlling a pest includes, but is not limited to, killing the pest, inhibiting development of the pest, altering fertility or growth of the pest in such a manner that the pest provides less damage to the plant, decreasing the number of offspring produced, producing less fit pests, producing pests more susceptible to predator attack or deterring the pests from eating the plant.

In some embodiments methods are provided for controlling an insect pest population resistant to a pesticidal protein, comprising contacting the insect pest population, either simultaneously or sequentially, with an insecticidally-effective amount of a recombinant IPD080 polypeptide or chimeric IPD080 polypeptide of the disclosure. In some embodiments methods are provided for controlling an insect pest population resistant to a pesticidal protein, comprising contacting the insect pest population with an insecticidally-effective amount of a recombinant IPD080 polypeptide of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344 or SEQ ID NO: 345 or a variant thereof.

In some embodiments methods are provided for protecting a plant from an insect pest, comprising expressing in the plant or cell thereof at least one recombinant polynucleotide encoding an IPD080 polypeptide or chimeric IPD080 polypeptide. In some embodiments methods are provided for protecting a plant from an insect pest, comprising expressing in the plant or cell thereof a recombinant polynucleotide encoding IPD080 polypeptide of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318 or variants thereof.

Insect Resistance Management (IRM) Strategies

Expression of *B. thuringiensis* δ-endotoxins in transgenic corn plants has proven to be an effective means of controlling agriculturally important insect pests (Perlak, et al., 1990; 1993). However, insects have evolved that are resistant to *B. thuringiensis* δ-endotoxins expressed in transgenic plants. Such resistance, should it become widespread, would clearly limit the commercial value of germplasm containing genes encoding such *B. thuringiensis* δ-endotoxins.

One way to increasing the effectiveness of the transgenic insecticides against target pests and contemporaneously reducing the development of insecticide-resistant pests is to use provide non-transgenic (i.e., non-insecticidal protein) refuges (a section of non-insecticidal crops/corn) for use with transgenic crops producing a single insecticidal protein active against target pests. The United States Environmental Protection Agency (epa.gov/oppbppdl/biopesticides/pips/bt_corn_refuge_2006.htm, which can be accessed using the www prefix) publishes the requirements for use with transgenic crops producing a single Bt protein active against target pests. In addition, the National Corn Growers Association, on their website: (ncga.com/insect-resistance-management-fact-sheet-bt-corn, which can be accessed using the www prefix) also provides similar guidance regarding refuge requirements. Due to losses to insects within the refuge area, larger refuges may reduce overall yield.

Another way of increasing the effectiveness of the transgenic insecticides against target pests and contemporaneously reducing the development of insecticide-resistant pests would be to have a repository of insecticidal genes that are effective against groups of insect pests and which manifest their effects through different modes of action.

Expression in a plant of two or more insecticidal compositions toxic to the same insect species, each insecticide being expressed at efficacious levels would be another way to achieve control of the development of resistance. This is based on the principle that evolution of resistance against two separate modes of action is far more unlikely than only one. Roush, for example, outlines two-toxin strategies, also called "pyramiding" or "stacking," for management of insecticidal transgenic crops. (The Royal Society. Phil. Trans. R. Soc. Lond. B. (1998) 353:1777-1786). Stacking or pyramiding of two different proteins each effective against the target pests and with little or no cross-resistance can allow for use of a smaller refuge. The US Environmental Protection Agency requires significantly less (generally 5%) structured refuge of non-Bt corn be planted than for single trait products (generally 20%). There are various ways of providing the IRM effects of a refuge, including various geometric planting patterns in the fields and in-bag seed mixtures, as discussed further by Roush.

In some embodiments, the IPD080 polypeptides of the disclosure are useful as an insect resistance management strategy in combination (i.e., pyramided) with other pesticidal proteins include but are not limited to Bt toxins, *Xenorhabdus* sp. or *Photorhabdus* sp. insecticidal proteins, other insecticidally active proteins, and the like.

Provided are methods of controlling Lepidoptera and/or Coleoptera insect infestation(s) in a transgenic plant that promote insect resistance management, comprising expressing in the plant at least two different insecticidal proteins having different modes of action.

In some embodiments, the methods of controlling Lepidoptera and/or Coleoptera insect infestation in a transgenic plant and promoting insect resistance management comprises the presentation of at least one of the IPD080 polypeptide insecticidal proteins to insects in the order Lepidoptera and/or Coleoptera.

In some embodiments the methods of controlling Lepidoptera and/or Coleoptera insect infestation in a transgenic plant and promoting insect resistance management comprises the presentation of at least one of the IPD080 polypeptides of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318 or variants thereof, insecticidal to insects in the order Lepidoptera and/or Coleoptera.

In some embodiments, the methods of controlling Lepidoptera and/or Coleoptera insect infestation in a transgenic plant and promoting insect resistance management comprise expressing in the transgenic plant an IPD080 polypeptide and a Cry protein or other insecticidal protein to insects in the order Lepidoptera and/or Coleoptera having different modes of action.

In some embodiments the methods, of controlling Lepidoptera and/or Coleoptera insect infestation in a transgenic plant and promoting insect resistance management, comprise expression in the transgenic plant an IPD080 polypeptide of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318 or variants thereof and a Cry protein or other insecticidal protein to insects in the order Lepidoptera and/or Coleoptera, where the IPD080 polypeptide and Cry protein have different modes of action.

Also provided are methods of reducing likelihood of emergence of Lepidoptera and/or Coleoptera insect resistance to transgenic plants expressing in the plants insecticidal proteins to control the insect species, comprising expression of an IPD080 polypeptide insecticidal to the insect species in combination with a second insecticidal protein to the insect species having different modes of action.

Also provided are means for effective Lepidoptera and/or Coleoptera insect resistance management of transgenic plants, comprising co-expressing at high levels in the plants two or more insecticidal proteins toxic to Lepidoptera and/or Coleoptera insects but each exhibiting a different mode of effectuating its killing activity, wherein the two or more insecticidal proteins comprise an IPD080 polypeptide and a Cry protein. Also provided are means for effective Lepidoptera and/or Coleoptera insect resistance management of transgenic plants, comprising co-expressing at high levels in the plants two or more insecticidal proteins toxic to Lepidoptera and/or Coleoptera insects but each exhibiting a different mode of effectuating its killing activity, wherein the two or more insecticidal proteins comprise an IPD080 polypeptide of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318 or variants thereof and a Cry protein or other insecticidally active protein.

In addition, methods are provided for obtaining regulatory approval for planting or commercialization of plants expressing proteins insecticidal to insects in the order Lepidoptera and/or Coleoptera, comprising the step of referring to, submitting or relying on insect assay binding data showing that the IPD080 polypeptide does not compete with binding sites for Cry proteins in such insects. In addition, methods are provided for obtaining regulatory approval for planting or commercialization of plants expressing proteins insecticidal to insects in the order Lepidoptera and/or Coleoptera, comprising the step of referring to, submitting or relying on insect assay binding data showing that the IPD080 polypeptide of SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318 or variant thereof does not compete with binding sites for Cry proteins in such insects.

Methods for Increasing Plant Yield

Methods for increasing plant yield are provided. The methods comprise providing a plant or plant cell expressing a polynucleotide encoding the pesticidal polypeptide sequence disclosed herein and growing the plant or a seed thereof in a field infested with a pest against which the polypeptide has pesticidal activity. In some embodiments, the polypeptide has pesticidal activity against a Lepidopteran, Coleopteran, Dipteran, Hemipteran or nematode pest, and the field is infested with a Lepidopteran, Hemipteran, Coleopteran, Dipteran or nematode pest.

As defined herein, the "yield" of the plant refers to the quality and/or quantity of biomass produced by the plant.

"Biomass" as used herein refers to any measured plant product. An increase in biomass production is any improvement in the yield of the measured plant product. Increasing plant yield has several commercial applications. For example, increasing plant leaf biomass may increase the yield of leafy vegetables for human or animal consumption. Additionally, increasing leaf biomass can be used to increase production of plant-derived pharmaceutical or industrial products. An increase in yield can comprise any statistically significant increase including, but not limited to, at least a 1% increase, at least a 3% increase, at least a 5% increase, at least a 10% increase, at least a 20% increase, at least a 30%, at least a 50%, at least a 70%, at least a 100% or a greater increase in yield compared to a plant not expressing the pesticidal sequence.

In specific methods, plant yield is increased as a result of improved pest resistance of a plant expressing an IPD080 polypeptide disclosed herein. Expression of the IPD080 polypeptide results in a reduced ability of a pest to infest or feed on the plant, thus improving plant yield.

Methods of Processing

Further provided are methods of processing a plant, plant part or seed to obtain a food or feed product from a plant, plant part or seed comprising an IPD080 polynucleotide. The plants, plant parts or seeds provided herein, can be processed to yield oil, protein products and/or by-products that are derivatives obtained by processing that have commercial value. Non-limiting examples include transgenic seeds comprising a nucleic acid molecule encoding an IPD080 polypeptide which can be processed to yield soy oil, soy products and/or soy by-products.

"Processing" refers to any physical and chemical methods used to obtain any soy product and includes, but is not limited to, heat conditioning, flaking and grinding, extrusion, solvent extraction or aqueous soaking and extraction of whole or partial seeds The following examples are offered by way of illustration and not by way of limitation.

EXAMPLES

Example 1—Identification of an Insecticidal Protein Active Against Lepidoptera Species from the Fern, *Huperzia* Phlegmaria The insecticidal protein IPD080Aa (SEQ ID NO: 159) was identified by protein purification, mass spectrometry (MS) and PCR cloning from *Huperzia phlegmaria* (L.) Rothm., identification number PS-8582 as follows. A sample of *Huperzia phlegmaria* (PS-8582) was collected, flash frozen in liquid $N_2$ and stored at −80° C. After storage, it was ground to a fine powder at liquid $N_2$ temperatures with a Geno/Grinder® Ball Mill (SPEX Sample Prep LLC, Metuchen, N.J.). To extract protein, 20 ml of 50 mM 2-Amino-2-hydroxymethyl-propane-1,3-diol (Tris buffer), pH 8.0, 150 mM KCl, 2.5 mM EDTA, 1.5% polyvinylpolypyrrolidone (PVPP) and protease inhibitor cocktail (Roche Diagnostics, Germany) was added to every 5 grams of fresh weight of tissue. The homogenate was centrifuged to remove cell debris, filtered through 0.22 um filters and desalted using 10 ml Zeba™ Spin Desalting columns (Thermo Scientific, IL.).

In-vitro bioassays against European corn borer (ECB) (*Ostrinia nubilalis*) were conducted using the desalted protein extract overlaid onto an agar-based Lepidoptera diet (Southland Products Inc., Lake Village, Ark.) in a 96-well plate format. Three numbers of replicates were used per sample. Samples were allowed to dry on top of the diet and five to eight neonate insects were placed into each well of the treated plate. After 96 hours of incubation at 27° C., larvae were scored for mortality or severity of stunting. The scores were recorded numerically as dead (3), severely stunted (2) (little or no growth but alive and equivalent to a 1st instar larvae), stunted (1) (growth to second instar but not equivalent to controls), or normal (0). Subjecting the sample to proteinase K and heat treatments resulted in loss of activity indicating that the sample was proteinaceous in nature. Bioassay results are shown in Table 1.

TABLE 1

| Average Score of Desalted material | Average score after proteinase K/Heat Treatment |
|---|---|
| 2 | 0 |

Example 2—Purification of IPD080 Insecticidal Proteins

The IPD080Aa polypeptide (SEQ ID NO: 159) was purified from *Huperzia phlegmaria* plant tissue by the following method. A sample of LW8582 was removed from the −80 freezer and 20 g was weighed under dry ice temperatures. LW8582 plant material was ground and the protein fraction extracted and desalted as described in Example 1. The desalted material was applied to a 5 ml GE HiTrap™ SP (GE, Piscataway, N.J.) in three runs. Runs one and two were eluted with a linear 60 column volume gradient from 0 to 0.7 M Sodium Chloride (NaCl) in 50 mM 2-(N-morpholino)ethanesulionic add (MES), pH 6.0, and collected in 1.5 ml fractions. Run 3 was eluted with a linear 30 column volume gradient from 0 to 0.35M NaCl in 50 mM MES, pH 6.0 and collected in 1.5 ml fractions. The fractions were run in bioassay and the B4 to C10 fractions were identified with activity on ECB. Fractions B1 to C11 were combined and concentrated to 15 ml using Amicon® molecular weight cutoff filtration (Millipore, Billerica, Mass.) for 3kD. The 15 ml retentate was desalted and buffer exchanged to 50 mM Tris and 13 ml was injected onto a MonoQ 5/50 column (GE, Piscataway, N.J.). The sample was eluted with a linear 150 column volume gradient from 0 to 0.6M Sodium Chloride (NaCl) in 50 mM Tris Buffer, pH 8.0, and collected in 0.75 ml fractions. SDS-PAGE of the ECB active fractions contained a Coomassie® stained band at ~35kD which was excised and tryptic digested.

In a second protein purification scheme, 50 g of LW8582 plant material was ground and the protein fraction extracted and desalted as described in Example 1. The desalted material was applied to a 5 ml GE HiTrap™ SP (GE, Piscataway, N.J.) and was eluted with a linear 30 column volume gradient from 0 to 0.35 M NaCl in 50 mM MES, pH 6.0, in 1.5 ml fractions. The SP flow through was identified as ECB active through in-vitro bioassay (as described above). The flow through was concentrated using Amicon® molecular weight cutoff filtration (Millipore, Billerica, Mass.) for 3kD. The ~3.2× concentrated retentate was brought up to 30% ammonium sulfate. The 30% ammonium sulfate solution was centrifuged to remove any precipitate. The 30% ammonium sulfate solute was applied to a 1 ml GE HiTrap™ Butyl HIC (GE, Piscataway, N.J.) column and eluted with a linear 50 column volume gradient from 1 to 0 M $AMSO_4$ in 50 mM MES, pH 6.0, in 1.0 ml fractions. Fractions were desalted with 0.5 ml Zeba™ desalting columns (Thermo Scientific, IL.) to remove AMSO$_4$. Active ECB fractions were identified as active through in-vitro bioassay (as described above). SDS-PAGE of the active fractions contained a Coomassie® Brilliant Blue G-250 Stain stained band at ~35kD and excised for MS identification.

Protein identification was performed by Mass Spectrometry (MS) analysis after protein digestion with trypsin. Proteins for MS identification were obtained after running the sample on an LDS-PAGE gel stained with Coomassie® Brilliant Blue G-250 Stain. The band of interest was excised from the gel, de-stained, reduced with dithiothreitol and then alkylated with iodoacetamide. Following overnight digestion with trypsin, the samples were submitted for Liquid chromatography-mass spectrometry (LC-MS) analysis. Liquid chromatography-tandem mass spectrometry (LC-MS/MS) analysis for tryptically-digested peptides was conducted using electrospray on a QToF Premiere™ mass spectrometer (Waters®, Milford, Mass.) coupled with a NanoAcquity™ nano-LC system (Waters®, Milford, Mass.) with a gradient from 2% acetonitrile, 0.1% formic acid to 60% acetonitrile, 0.1% formic acid.

The resulting LC-MS data were analyzed using ProteinLynx Global SERVER™ (Waters®, Milford, Mass.) to generate DeNovo sequence data. The amino acid sequences were BLAST (Basic Local Alignment Search Tool; Altschul, et al., (1993) J. Mol. Biol. 215:403-410; see also ncbi.nlm.nih.gov/BLAST/, which can be accessed using the www prefix) searched against public and DUPONT-PIONEER internal databases that included plant protein sequences. Amino acid sequences were aligned with proteins in a proprietary DUPONT-PIONEER plant protein database.

Example 3—Transcriptomic Sequencing of *Huperzia phlegmaria*

A transcriptome for *Huperzia phlegmaria*, (ID #PS 8582) was prepared as follows. Total RNAs were isolated from frozen tissues by use of the Qiagen® RNeasy® kit for total RNA isolation. Sequencing libraries from the resulting total RNAs were prepared using the TruSeq™ mRNA-Seq kit and protocol from Illumina®, Inc. (San Diego, Calif.). Briefly, mRNAs were isolated via attachment to oligo(dT) beads, fragmented to a mean size of 180 nt, reverse transcribed into cDNA by random hexamer prime, end repaired, 3' A-tailed, and ligated with Illumina® indexed TruSeq™ adapters. Ligated cDNA fragments were PCR amplified using Illumina® TruSeq™ primers and purified PCR products were checked for quality and quantity on the Agilent Bioanalyzer® DNA 7500 chip. Post quality and quantity assessment, 100 ng of the transcript library was normalized by treatment with Duplex Specific Nuclease (DSN) (Evrogen®, Moscow, Russia). Normalization was accomplished by addition of 200 mM Hepes buffer, followed by heat denaturation and five hour anneal at 68° C. Annealed library was treated with 2 ul of DSN enzyme for 25 minutes, purified by Qiagen® MinElute® columns according to manufacturer protocols, and amplified twelve cycles using Illumina® adapter specific primers. Final products were purified with Ampure® XP beads (Beckman Genomics, Danvers, Mass.) and checked for quality and quantity on the Agilent Bioanalyzer® DNA 7500 chip.

Normalized transcript libraries were sequenced according to manufacturer protocols on the Illumina® Genome Analyzer IIx. Each library was hybridized to two flowcell lanes and amplified, blocked, linearized and primer hybridized using the Illumina clonal cluster generation process on cBot®. Sequencing was completed on the Genome Analyzer IIx, generating sixty million 75 bp paired end reads per normalized library.

Example 4—Isolation of cDNA Encoding IPD080Aa

Peptide sequences identified for IPD080Aa (SEQ ID NO: 1) by LCMS sequencing (described in Example 3) were searched against the protein sequences predicted by open reading frames (ORFs) from the internal transcriptome for PS-8582 assemblies. The peptides gave a perfect match to a transcript corresponding to IPD080Aa (SEQ ID NO: 1). The coding sequences were used to design the following primers to clone the IPD080Aa coding sequence: CATCATATGTC-TATTCAAATCGACATCGAGCC (SEQ ID NO: 319) and CATCATATGTCTATTCAAATCGACATCGAGCC (SEQ ID NO: 320). This clone was produced by polymerase chain reaction using the HF Advantage® PCR kit (Clontech™, 1290 Terra Bella Ave. Mountain View, Calif. 94043) and the cDNA prepared from the total RNA from *Huperzia phlegmaria* using the SuperScript® II kit (Thermo Fischer Scientific, Waltham, Mass.) as the template. The cloned cDNA sequence was confirmed by sequencing. Based on the DNA and protein sequencing, the IPD080Aa polynucleotide sequence is shown as SEQ ID NO: 1 and the polypeptide sequence as SEQ ID NO: 159.

Example 5—Lepidoptera Assays with IPD080Aa Purified Proteins Expressed in *E. coli*

The cDNA (SEQ ID NO: 1) encoding IPD080Aa (SEQ ID NO: 160) was subcloned into the pET24a vector (Novagen) without a stop codon using the NdeI/XhoI restriction sites in frame with a C-terminal 6×His tag coding sequence (SEQ ID NO: 321). Chemically competent OverExpress™ C41(DE3) SOLOs cells (Lucigen) were transformed with pET plasmid DNA, containing the IPD080Aa gene insert for recombinant protein expression. The transformed *E. coli* cells were grown overnight at 37° C. with kanamycin selection and then inoculated to a fresh 2×YT medium (1:25) and further grown to an optical density of about 0.8. Protein expression was induced by adding 0.3 mM IPTG and cells were further grown at 16° C. for 16 hours. The *E. coli* expressed proteins were purified by immobilized metal ion chromatography using HisPur™ Cobalt resin (Thermo Fisher Scientific) according to the manufacturer's protocols. The purified fractions were loaded onto PD-10 desalting columns (GE Life Sciences, Pittsburgh, USA) pre-equilibrated with 1×PBS buffer. 3 mL of elute buffer was loaded on to each column and 2.5 mL of eluate collected from each column. The eluted protein was run in diet assay to evaluate the insecticidal protein effects on larvae of a diversity of Lepidoptera.

Bioassays against the five pest species, Corn earworm (CEW) (*Helicoverpa zea*), European corn borer (ECB) (*Ostrinia nubialis*), fall armyworm (FAW) (*Spodoptera frugiperda* JE Smith), Soybean looper (SBL) (*Pseudoplusia includens*), Black Cutworm (BCW) (*Agrotis ipsilon*) and velvet bean caterpillar (VBC) (*Anticarsia gemmatalis* Hubner) were conducted using a dilution series of purified IPD080Aa (SEQ ID NO: 160), expressed with a 6×His Tag, overlaid onto an agar-based Lepidoptera diet (Southland Products Inc., Lake Village, Ark.) in a 96-well plate format. Four replicates were used per sample. Samples was allowed to dry on top of the diet and two to five neonate insects were placed into each well of the treated plate. After four days of incubation at 27° C. larvae were scored for mortality or severity of stunting. The scores were recorded numerically as dead (3), severely stunted (2) (little or no growth but alive and equivalent to a 1$^{st}$ instar larvae), stunted (1) (growth to second instar but not equivalent to controls), or normal (0). The mean larval inhibition score of the 4 replicates assays of a dilution series of IPD080Aa (SEQ ID NO: 160), expressed with a 6xHis Tag against the Lepidoptera pests are shown in Table 2.

TABLE 2

|  | Dose (ug/cm$^2$) | FAW | BCW | ECB | VBC | SBL | CEW |
|---|---|---|---|---|---|---|---|
| IPD080Aa (SEQ ID NO: 160) 6xHis Tag | 227 | 2.75 | 2.75 | 3 | 3 | 2.5 | 2 |
|  | 113 | 2 | 2.5 | 3 | 3 | 2.5 | 1.75 |
|  | 57 | 2 | 2.25 | 3 | 3 | 1.5 | 1.25 |
|  | 28 | 1 | 2 | 2.25 | 3 | 2 | 1 |
|  | 14 | 0.5 | 2 | 2.75 | 2.75 | 1.75 | 0.25 |
|  | 7 | 0 | 2 | 3 | 2.5 | 0.75 | 0 |
|  | 3 | 0 | 1.25 | 2.75 | 2.25 | 0 | 0 |
|  | 2 | 0 | 0.75 | 2 | 2 | 0 | 0 |
|  | 1 | 0 | 0 | 2.25 | 2 | 0 | 0 |
|  | 0.5 | 0 | 0 | 2 | 2 | 0 | 0 |
| Buffer |  | 0 | 0 | 0 | 0 | 0 | 0 |

Example 6—Identification of IPD080Aa Homologs

Gene identities may be determined by conducting BLAST (Basic Local Alignment Search Tool; Altschul, et al., (1993) *J. Mol. Biol.* 215:403-410; see also ncbi.nlm.nih.gov/BLAST/, which can be accessed using the www prefix) searches under default parameters for similarity to sequences. The polynucleotide sequences for IPD080Aa (SEQ ID NO: 1) was analyzed. Multiple homologs of the IPD080Aa protein (SEQ ID NO: 160) were identified by a BLAST™ search of a DUPONT PIONEER internal plant transcriptomes database.

Figure 5:
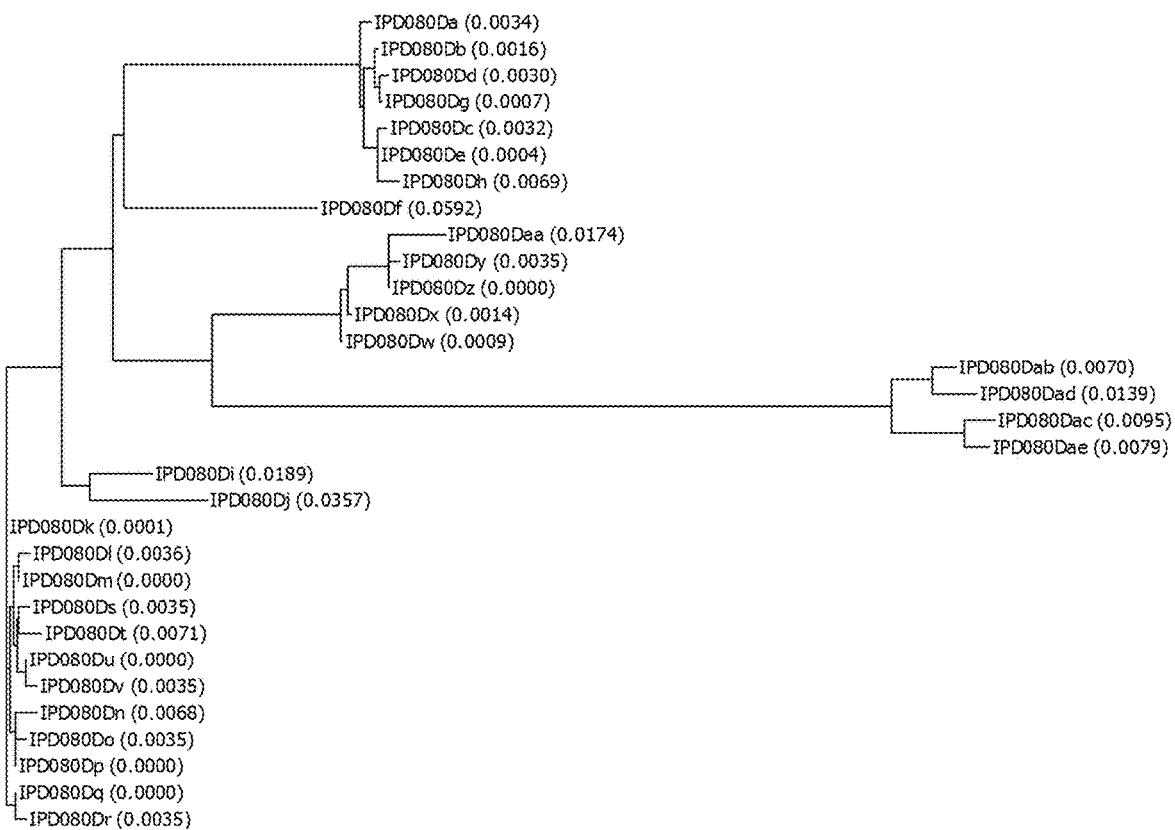
FIG. 5 shows a Phylogentic Tree, using the Neighbor Joining Method in the ALIGNX® module of the Vector NTI® suite, of the IPD080 homologs: IPD080 Da (SEQ ID NO: 288); IPD080Db (SEQ ID NO: 289); IPD080Dc (SEQ ID NO: 290); IPD080Dd (SEQ ID NO: 291); IPD080De (SEQ ID NO: 292); IPD080Df (SEQ ID NO: 293); IPD080Dg (SEQ ID NO: 294); IPD080Dh (SEQ ID NO: 295); IPD080Di (SEQ ID NO: 296); IPD080Dj (SEQ ID NO: 297); IPD080Dk (SEQ ID NO: 298); IPD080Dl (SEQ ID NO: 299); IPD080Dm (SEQ ID NO: 300); IPD080Dn (SEQ ID NO: 301); IPD080Do (SEQ ID NO: 302); IPD080Dp (SEQ ID NO: 303); IPD080Dq (SEQ ID NO: 304); IPD080Dr (SEQ ID NO: 305); IPD080Ds (SEQ ID NO: 306); IPD080Dt (SEQ ID NO: 307); IPD080Du (SEQ ID NO: 308); IPD080Dv (SEQ ID NO: 309); IPD080Dw (SEQ ID NO: 310); IPD080Dx (SEQ ID NO: 311); IPD080Dy (SEQ ID NO: 312); IPD080Dz (SEQ ID NO: 313); IPD080Daa (SEQ ID NO: 314); IPD080Dab (SEQ ID NO: 315); IPD080Dac (SEQ ID NO: 316); IPD080Dad (SEQ ID NO: 317); and IPD080Dae (SEQ ID NO: 318). The number in parentheses is the distant value.

Alignments of genes homologs of IPD080Aa were used to identify conserved sequences near the 5' and 3' termini of the coding sequences. Multiple PCR primers were designed within these conserved sequences. Reverse-transcription was performed according to the manufacturer's instructions (SuperScript® First-Strand Synthesis System, Invitrogen), followed by polymerase chain reaction (Phusion® High-Fidelity DNA Polymerase, New England BioLabs) from fern isolates PS-8582 *Huperzia phlegmaria*, PS-9149 *Huperzia goebelii*, PS-9151 *Phlegmariurus nummularifolius*, ES002 *Huperzia phlegmaria*, ES003 *Huperzia carinata* Philippines and ES007 *Huperzia carinata*. The resulting PCR products were cloned directly into the plasmid vector pCR-Blunt II-TOPO by Zero Blunt TOPO cloning (Life Technology). DNA sequencing was performed on random clones. Unique IPD080Aa homologs were sub-cloned into *E. coli* expression vector pET24 (Clontech) with a C-terminal 10xHis tag coding sequence (SEQ ID NO: 323). The IPD080Aa homologs and the organism from which they were identified are shown in Table 3. Amino acid sequence alignments of selected subgroups of the IPD080 homologs are shown in FIG. 1, FIG. 2, and FIG. 3. Phylogenetic trees of selected subgroups of the IPD080 homologs are shown in FIG. 4 and FIG. 5.

TABLE 3

| Gene Name | Source | Organism | polynucleotide | polypeptide |
|---|---|---|---|---|
| IPD080Aa | PS_8582 | *Huperzia phlegmaria* | SEQ ID NO: 1 | SEQ ID NO: 160 |
| IPD080Ab | PS_9151 | *Phlegmariurus nummularifolius* | SEQ ID NO: 2 | SEQ ID NO: 161 |
| IPD080Ac | PS_9151 | *Phlegmariurus nummularifolius* | SEQ ID NO: 3 | SEQ ID NO: 162 |
| IPD080Ad | PS_9151 | *Phlegmariurus nummularifolius* | SEQ ID NO: 4 | SEQ ID NO: 163 |
| IPD080Ae | PS_9151 | *Phlegmariurus nummularifolius* | SEQ ID NO: 5 | SEQ ID NO: 164 |
| IPD080Af | PS_9151 | *Phlegmariurus nummularifolius* | SEQ ID NO: 6 | SEQ ID NO: 165 |
| IPD080Ag | PS_9151 | *Phlegmariurus nummularifolius* | SEQ ID NO: 7 | SEQ ID NO: 166 |
| IPD080Ah | PS_9151 | *Phlegmariurus nummularifolius* | SEQ ID NO: 8 | SEQ ID NO: 167 |
| IPD080Ai | PS_9151 | *Phlegmariurus nummularifolius* | SEQ ID NO: 9 | SEQ ID NO: 168 |
| IPD080Aj | PS_9151 | *Phlegmariurus nummularifolius* | SEQ ID NO: 10 | SEQ ID NO: 169 |
| IPD080Ak | PS_9151 | *Phlegmariurus nummularifolius* | SEQ ID NO: 11 | SEQ ID NO: 170 |
| IPD080Al | PS_9151 | *Phlegmariurus nummularifolius* | SEQ ID NO: 12 | SEQ ID NO: 171 |
| IPD080Am | PS_9151 | *Phlegmariurus nummularifolius* | SEQ ID NO: 13 | SEQ ID NO: 172 |
| IPD080An | PS_9151 | *Phlegmariurus nummularifolius* | SEQ ID NO: 14 | SEQ ID NO: 173 |
| IPD080Ao | PS_9151 | *Phlegmariurus nummularifolius* | SEQ ID NO: 15 | SEQ ID NO: 174 |
| IPD080Ap | PS_9151 | *Phlegmariurus nummularifolius* | SEQ ID NO: 16 | SEQ ID NO: 175 |
| IPD080Aq | PS_9151 | *Phlegmariurus nummularifolius* | SEQ ID NO: 17 | SEQ ID NO: 176 |
| IPD080Ar | PS_9151 | *Phlegmariurus nummularifolius* | SEQ ID NO: 18 | SEQ ID NO: 177 |
| IPD080As | PS_9151 | *Phlegmariurus nummularifolius* | SEQ ID NO: 19 | SEQ ID NO: 178 |
| IPD080At | PS_9151 | *Phlegmariurus nummularifolius* | SEQ ID NO: 20 | SEQ ID NO: 179 |
| IPD080Au | PS_9151 | *Phlegmariurus nummularifolius* | SEQ ID NO: 21 | SEQ ID NO: 180 |
| IPD080Av | PS_9151 | *Phlegmariurus nummularifolius* | SEQ ID NO: 22 | SEQ ID NO: 181 |
| IPD080Aw | PS_9151 | *Phlegmariurus nummularifolius* | SEQ ID NO: 23 | SEQ ID NO: 182 |
| IPD080Ax | PS_9151 | *Phlegmariurus nummularifolius* | SEQ ID NO: 24 | SEQ ID NO: 183 |
| IPD080Ay | PS_9151 | *Phlegmariurus nummularifolius* | SEQ ID NO: 25 | SEQ ID NO: 184 |
| IPD080Az | PS_9151 | *Phlegmariurus nummularifolius* | SEQ ID NO: 26 | SEQ ID NO: 185 |
| IPD080Aaa | PS_9151 | *Phlegmariurus nummularifolius* | SEQ ID NO: 27 | SEQ ID NO: 186 |
| IPD080Aab | PS_9151 | *Phlegmariurus nummularifolius* | SEQ ID NO: 28 | SEQ ID NO: 187 |
| IPD080Aac | PS_9151 | *Phlegmariurus nummularifolius* | SEQ ID NO: 29 | SEQ ID NO: 188 |
| IPD080Aad | PS_9151 | *Phlegmariurus nummularifolius* | SEQ ID NO: 30 | SEQ ID NO: 189 |
| IPD080Aae | PS_9151 | *Phlegmariurus nummularifolius* | SEQ ID NO: 31 | SEQ ID NO: 190 |
| IPD080Aaf | PS_9151 | *Phlegmariurus nummularifolius* | SEQ ID NO: 32 | SEQ ID NO: 191 |
| IPD080Aag | PS_9151 | *Phlegmariurus nummularifolius* | SEQ ID NO: 33 | SEQ ID NO: 192 |
| IPD080Aah | PS_9151 | *Phlegmariurus nummularifolius* | SEQ ID NO: 34 | SEQ ID NO: 193 |
| IPD080Aai | PS_9151 | *Phlegmariurus nummularifolius* | SEQ ID NO: 35 | SEQ ID NO: 194 |
| IPD080Aaj | PS_9151 | *Phlegmariurus nummularifolius* | SEQ ID NO: 36 | SEQ ID NO: 195 |
| IPD080Aak | PS_9151 | *Phlegmariurus nummularifolius* | SEQ ID NO: 37 | SEQ ID NO: 196 |
| IPD080Aal | PS_9151 | *Phlegmariurus nummularifolius* | SEQ ID NO: 38 | SEQ ID NO: 197 |

TABLE 3-continued

| Gene Name | Source | Organism | polynucleotide | polypeptide |
| --- | --- | --- | --- | --- |
| IPD080Aam | PS_9151 | Phlegmariurus nummularifolius | SEQ ID NO: 39 | SEQ ID NO: 198 |
| IPD080Aan | PS_9151 | Phlegmariurus nummularifolius | SEQ ID NO: 40 | SEQ ID NO: 199 |
| IPD080Aao | PS_9151 | Phlegmariurus nummularifolius | SEQ ID NO: 41 | SEQ ID NO: 200 |
| IPD080Aap | PS_9151 | Phlegmariurus nummularifolius | SEQ ID NO: 42 | SEQ ID NO: 201 |
| IPD080Aaq | PS_9151 | Phlegmariurus nummularifolius | SEQ ID NO: 43 | SEQ ID NO: 202 |
| IPD080Aar | PS_9151 | Phlegmariurus nummularifolius | SEQ ID NO: 44 | SEQ ID NO: 203 |
| IPD080Aas | PS_9151 | Phlegmariurus nummularifolius | SEQ ID NO: 45 | SEQ ID NO: 204 |
| IPD080Aat | PS_9151 | Phlegmariurus nummularifolius | SEQ ID NO: 46 | SEQ ID NO: 205 |
| IPD080Aau | PS_9151 | Phlegmariurus nummularifolius | SEQ ID NO: 47 | SEQ ID NO: 206 |
| IPD080Aav | PS_9151 | Phlegmariurus nummularifolius | SEQ ID NO: 48 | SEQ ID NO: 207 |
| IPD080Aaw | PS_9151 | Phlegmariurus nummularifolius | SEQ ID NO: 49 | SEQ ID NO: 208 |
| IPD080Aax | PS_9151 | Phlegmariurus nummularifolius | SEQ ID NO: 50 | SEQ ID NO: 209 |
| IPD080Aay | PS_9151 | Phlegmariurus nummularifolius | SEQ ID NO: 51 | SEQ ID NO: 210 |
| IPD080Aaz | PS_9151 | Phlegmariurus nummularifolius | SEQ ID NO: 52 | SEQ ID NO: 211 |
| IPD080Aba | PS_9151 | Phlegmariurus nummularifolius | SEQ ID NO: 53 | SEQ ID NO: 212 |
| IPD080Abc | PS_9151 | Phlegmariurus nummularifolius | SEQ ID NO: 54 | SEQ ID NO: 213 |
| IPD080Abd | PS_9151 | Phlegmariurus nummularifolius | SEQ ID NO: 55 | SEQ ID NO: 214 |
| IPD080Abe | PS_9151 | Phlegmariurus nummularifolius | SEQ ID NO: 56 | SEQ ID NO: 215 |
| IPD080Abf | PS_9151 | Phlegmariurus nummularifolius | SEQ ID NO: 57 | SEQ ID NO: 216 |
| IPD080Abg | PS_9151 | Phlegmariurus nummularifolius | SEQ ID NO: 58 | SEQ ID NO: 217 |
| IPD080Abh | PS_9151 | Phlegmariurus nummularifolius | SEQ ID NO: 59 | SEQ ID NO: 218 |
| IPD080Abi | PS_9151 | Phlegmariurus nummularifolius | SEQ ID NO: 60 | SEQ ID NO: 219 |
| IPD080Abj | PS_9151 | Phlegmariurus nummularifolius | SEQ ID NO: 61 | SEQ ID NO: 220 |
| IPD080Abk | PS_9151 | Phlegmariurus nummularifolius | SEQ ID NO: 62 | SEQ ID NO: 221 |
| IPD080Abl | PS_9151 | Phlegmariurus nummularifolius | SEQ ID NO: 63 | SEQ ID NO: 222 |
| IPD080Abm | PS_9151 | Phlegmariurus nummularifolius | SEQ ID NO: 64 | SEQ ID NO: 223 |
| IPD080Abn | PS_9151 | Phlegmariurus nummularifolius | SEQ ID NO: 65 | SEQ ID NO: 224 |
| IPD080Abo | PS_9151 | Phlegmariurus nummularifolius | SEQ ID NO: 66 | SEQ ID NO: 225 |
| IPD080Abp | PS_9151 | Phlegmariurus nummularifolius | SEQ ID NO: 67 | SEQ ID NO: 226 |
| IPD080Abq | PS_9151 | Phlegmariurus nummularifolius | SEQ ID NO: 68 | SEQ ID NO: 227 |
| IPD080Abr | PS_9151 | Phlegmariurus nummularifolius | SEQ ID NO: 69 | SEQ ID NO: 228 |
| IPD080Abs | PS_9151 | Phlegmariurus nummularifolius | SEQ ID NO: 70 | SEQ ID NO: 229 |
| IPD080Abt | PS_9151 | Phlegmariurus nummularifolius | SEQ ID NO: 71 | SEQ ID NO: 230 |
| IPD080Abu | PS_9151 | Phlegmariurus nummularifolius | SEQ ID NO: 72 | SEQ ID NO: 231 |
| IPD080Abv | PS_9151 | Phlegmariurus nummularifolius | SEQ ID NO: 73 | SEQ ID NO: 232 |
| IPD080Abw | PS_9151 | Phlegmariurus nummularifolius | SEQ ID NO: 74 | SEQ ID NO: 233 |
| IPD080Abx | PS_9151 | Phlegmariurus nummularifolius | SEQ ID NO: 75 | SEQ ID NO: 234 |
| IPD080Aby | PS_9151 | Phlegmariurus nummularifolius | SEQ ID NO: 76 | SEQ ID NO: 235 |
| IPD080Abz | PS_9151 | Phlegmariurus nummularifolius | SEQ ID NO: 77 | SEQ ID NO: 236 |
| IPD080Aca | PS_9151 | Phlegmariurus nummularifolius | SEQ ID NO: 78 | SEQ ID NO: 237 |
| IPD080Acb | PS_9151 | Phlegmariurus nummularifolius | SEQ ID NO: 79 | SEQ ID NO: 238 |
| IPD080Acc | PS_9151 | Phlegmariurus nummularifolius | SEQ ID NO: 80 | SEQ ID NO: 239 |
| IPD080Acd | PS_9151 | Phlegmariurus nummularifolius | SEQ ID NO: 81 | SEQ ID NO: 240 |
| IPD080Ace | PS_9151 | Phlegmariurus nummularifolius | SEQ ID NO: 82 | SEQ ID NO: 241 |
| IPD080Acf | PS_9151 | Phlegmariurus nummularifolius | SEQ ID NO: 83 | SEQ ID NO: 242 |
| IPD080Acg | PS_9151 | Phlegmariurus nummularifolius | SEQ ID NO: 84 | SEQ ID NO: 243 |
| IPD080Ach | PS_9151 | Phlegmariurus nummularifolius | SEQ ID NO: 85 | SEQ ID NO: 244 |
| IPD080Aci | PS_9151 | Phlegmariurus nummularifolius | SEQ ID NO: 86 | SEQ ID NO: 245 |
| IPD080Acj | PS_9151 | Phlegmariurus nummularifolius | SEQ ID NO: 87 | SEQ ID NO: 246 |
| IPD080Ack | PS_9151 | Phlegmariurus nummularifolius | SEQ ID NO: 88 | SEQ ID NO: 247 |
| IPD080Acl | PS_9151 | Phlegmariurus nummularifolius | SEQ ID NO: 89 | SEQ ID NO: 248 |
| IPD080Acm | PS_9151 | Phlegmariurus nummularifolius | SEQ ID NO: 90 | SEQ ID NO: 249 |
| IPD080Acn | PS_9151 | Phlegmariurus nummularifolius | SEQ ID NO: 91 | SEQ ID NO: 250 |
| IPD080Aco | PS_9151 | Phlegmariurus nummularifolius | SEQ ID NO: 92 | SEQ ID NO: 251 |
| IPD080Acp | PS_9151 | Phlegmariurus nummularifolius | SEQ ID NO: 93 | SEQ ID NO: 252 |
| IPD080Acq | PS_9151 | Phlegmariurus nummularifolius | SEQ ID NO: 94 | SEQ ID NO: 253 |
| IPD080Acr | PS_9151 | Phlegmariurus nummularifolius | SEQ ID NO: 95 | SEQ ID NO: 254 |
| IPD080Acs | PS_9151 | Phlegmariurus nummularifolius | SEQ ID NO: 96 | SEQ ID NO: 255 |
| IPD080Act | PS_9151 | Phlegmariurus nummularifolius | SEQ ID NO: 97 | SEQ ID NO: 256 |
| IPD080Acu | PS_9151 | Phlegmariurus nummularifolius | SEQ ID NO: 98 | SEQ ID NO: 257 |
| IPD080Acv | PS_9151 | Phlegmariurus nummularifolius | SEQ ID NO: 99 | SEQ ID NO: 258 |
| IPD080Acw | PS_9151 | Phlegmariurus nummularifolius | SEQ ID NO: 100 | SEQ ID NO: 259 |
| IPD080Acx | PS_9151 | Phlegmariurus nummularifolius | SEQ ID NO: 101 | SEQ ID NO: 260 |
| IPD080Acy | PS_8582 | Huperzia phlegmaria | SEQ ID NO: 102 | SEQ ID NO: 261 |
| IPD080Acz | PS_8582 | Huperzia phlegmaria | SEQ ID NO: 103 | SEQ ID NO: 262 |
| IPD080Ada | PS_8582 | Huperzia phlegmaria | SEQ ID NO: 104 | SEQ ID NO: 263 |
| IPD080Adb | PS_8582 | Huperzia phlegmaria | SEQ ID NO: 105 | SEQ ID NO: 264 |
| IPD080Adc | PS_8582 | Huperzia phlegmaria | SEQ ID NO: 106 | SEQ ID NO: 265 |
| IPD080Ade | PS_8582 | Huperzia phlegmaria | SEQ ID NO: 107 | SEQ ID NO: 266 |
| IPD080Adf | PS_8582 | Huperzia phlegmaria | SEQ ID NO: 108 | SEQ ID NO: 267 |
| IPD080Adg | PS_8582 | Huperzia phlegmaria | SEQ ID NO: 109 | SEQ ID NO: 268 |
| IPD080Adh | PS_8582 | Huperzia phlegmaria | SEQ ID NO: 110 | SEQ ID NO: 269 |
| IPD080Adi | PS_8582 | Huperzia phlegmaria | SEQ ID NO: 111 | SEQ ID NO: 270 |
| IPD080Adj | ES-0002 | Huperzia phlegmaria | SEQ ID NO: 112 | SEQ ID NO: 271 |
| IPD080Adk | ES-0002 | Huperzia phlegmaria | SEQ ID NO: 113 | SEQ ID NO: 272 |
| IPD080Ba | PS_9151 | Phlegmariurus nummularifolius | SEQ ID NO: 114 | SEQ ID NO: 273 |
| IPD080Bb | PS_9151 | Phlegmariurus nummularifolius | SEQ ID NO: 115 | SEQ ID NO: 274 |
| IPD080Bc | PS_9151 | Phlegmariurus nummularifolius | SEQ ID NO: 116 | SEQ ID NO: 275 |

TABLE 3-continued

| Gene Name | Source | Organism | polynucleotide | polypeptide |
|---|---|---|---|---|
| IPD080Bd | PS_9151 | *Phlegmariurus nummularifolius* | SEQ ID NO: 117 | SEQ ID NO: 276 |
| IPD080Be | PS_9151 | *Phlegmariurus nummularifolius* | SEQ ID NO: 118 | SEQ ID NO: 277 |
| IPD080Bf | PS_8582 | *Huperzia phlegmaria* | SEQ ID NO: 119 | SEQ ID NO: 278 |
| IPD080Bg | PS_8582 | *Huperzia phlegmaria* | SEQ ID NO: 120 | SEQ ID NO: 279 |
| IPD080Bh | PS_8582 | *Huperzia phlegmaria* | SEQ ID NO: 121 | SEQ ID NO: 280 |
| IPD080Bi | PS_8582 | *Huperzia phlegmaria* | SEQ ID NO: 122 | SEQ ID NO: 281 |
| IPD080Bj | PS_8582 | *Huperzia phlegmaria* | SEQ ID NO: 123 | SEQ ID NO: 282 |
| IPD080Bk | ES-0003 | *Huperzia carinata* Philipines | SEQ ID NO: 124 | SEQ ID NO: 283 |
| IPD080Bl | ES-0003 | *Huperzia carinata* Philipines | SEQ ID NO: 125 | SEQ ID NO: 284 |
| IPD080Bm | ES-0003 | *Huperzia carinata* Philipines | SEQ ID NO: 126 | SEQ ID NO: 285 |
| IPD080Bn | ES-0003 | *Huperzia carinata* Philipines | SEQ ID NO: 127 | SEQ ID NO: 286 |
| IPD080Bo | ES-0003 | *Huperzia carinata* Philipines | SEQ ID NO: 128 | SEQ ID NO: 287 |
| IPD080Da | PS_9149CF | *Huperzia goebelii* | SEQ ID NO: 129 | SEQ ID NO: 288 |
| IPD080Db | PS_9149CF | *Huperzia goebelii* | SEQ ID NO: 130 | SEQ ID NO: 289 |
| IPD080Dc | PS_9149CF | *Huperzia goebelii* | SEQ ID NO: 131 | SEQ ID NO: 290 |
| IPD080Dd | PS_9149CF | *Huperzia goebelii* | SEQ ID NO: 132 | SEQ ID NO: 291 |
| IPD080De | PS_9149CF | *Huperzia goebelii* | SEQ ID NO: 133 | SEQ ID NO: 292 |
| IPD080Df | PS_9149CF | *Huperzia goebelii* | SEQ ID NO: 134 | SEQ ID NO: 293 |
| IPD080Dg | PS_9149CF | *Huperzia goebelii* | SEQ ID NO: 135 | SEQ ID NO: 294 |
| IPD080Dh | PS_9149CF | *Huperzia goebelii* | SEQ ID NO: 136 | SEQ ID NO: 295 |
| IPD080Di | ES007 | *Huperzia carinata* | SEQ ID NO: 137 | SEQ ID NO: 296 |
| IPD080Dj | ES007 | *Huperzia carinata* | SEQ ID NO: 138 | SEQ ID NO: 297 |
| IPD080Dk | ES-0002 | *Huperzia phlegmaria* | SEQ ID NO: 139 | SEQ ID NO: 298 |
| IPD080Dl | ES-0002 | *Huperzia phlegmaria* | SEQ ID NO: 140 | SEQ ID NO: 299 |
| IPD080Dm | ES-0002 | *Huperzia phlegmaria* | SEQ ID NO: 141 | SEQ ID NO: 300 |
| IPD080Dn | ES-0002 | *Huperzia phlegmaria* | SEQ ID NO: 142 | SEQ ID NO: 301 |
| IPD080Do | ES-0002 | *Huperzia phlegmaria* | SEQ ID NO: 143 | SEQ ID NO: 302 |
| IPD080Dp | ES-0002 | *Huperzia phlegmaria* | SEQ ID NO: 144 | SEQ ID NO: 303 |
| IPD080Dq | ES-0002 | *Huperzia phlegmaria* | SEQ ID NO: 145 | SEQ ID NO: 304 |
| IPD080Dr | ES-0002 | *Huperzia phlegmaria* | SEQ ID NO: 146 | SEQ ID NO: 305 |
| IPD080Ds | ES-0002 | *Huperzia phlegmaria* | SEQ ID NO: 147 | SEQ ID NO: 306 |
| IPD080Dt | ES-0002 | *Huperzia phlegmaria* | SEQ ID NO: 148 | SEQ ID NO: 307 |
| IPD080Du | ES-0002 | *Huperzia phlegmaria* | SEQ ID NO: 149 | SEQ ID NO: 308 |
| IPD080Dv | ES-0002 | *Huperzia phlegmaria* | SEQ ID NO: 150 | SEQ ID NO: 309 |
| IPD080Dw | ES-0002 | *Huperzia phlegmaria* | SEQ ID NO: 151 | SEQ ID NO: 310 |
| IPD080Dx | ES-0002 | *Huperzia phlegmaria* | SEQ ID NO: 152 | SEQ ID NO: 311 |
| IPD080Dy | ES-0002 | *Huperzia phlegmaria* | SEQ ID NO: 153 | SEQ ID NO: 312 |
| IPD080Dz | ES-0002 | *Huperzia phlegmaria* | SEQ ID NO: 154 | SEQ ID NO: 313 |
| IPD080Daa | ES-0002 | *Huperzia phlegmaria* | SEQ ID NO: 155 | SEQ ID NO: 314 |
| IPD080Dab | PS_8582 | *Huperzia phlegmaria* | SEQ ID NO: 156 | SEQ ID NO: 315 |
| IPD080Dac | PS_8582 | *Huperzia phlegmaria* | SEQ ID NO: 157 | SEQ ID NO: 316 |
| IPD080Dad | PS_8582 | *Huperzia phlegmaria* | SEQ ID NO: 158 | SEQ ID NO: 317 |
| IPD080Dae | PS_8582 | *Huperzia phlegmaria* | SEQ ID NO: 159 | SEQ ID NO: 318 |

The percent identity compared to IPD080Aa (SEQ ID NO: 160), based upon the Needleman-Wunsch algorithm, of a selected group of IPD080Aa homologs is shown in Table 4. A matrix table of pair-wise identity, based upon the Needleman-Wunsch algorithm (Needle program in EMBOSS tool suite) for the IPD080B subgroup of homologs is shown in Table 5.

TABLE 4

| Identifier | polypeptide | % |
|---|---|---|
| IPD080Aaa | SEQ ID NO: 186 | 92.1 |
| IPD080Aab | SEQ ID NO: 187 | 92.1 |
| IPD080Aac | SEQ ID NO: 188 | 92.1 |
| IPD080Aad | SEQ ID NO: 189 | 92.7 |
| IPD080Aae | SEQ ID NO: 190 | 91.7 |
| IPD080Aaf | SEQ ID NO: 191 | 92.7 |
| IPD080Aag | SEQ ID NO: 192 | 92.4 |
| IPD080Aah | SEQ ID NO: 193 | 92.4 |
| IPD080Aai | SEQ ID NO: 194 | 92.1 |
| IPD080Aaj | SEQ ID NO: 195 | 91.7 |
| IPD080Aak | SEQ ID NO: 196 | 92.4 |
| IPD080Aal | SEQ ID NO: 197 | 91.7 |
| IPD080Aam | SEQ ID NO: 198 | 91.7 |
| IPD080Aan | SEQ ID NO: 199 | 90.1 |
| IPD080Aao | SEQ ID NO: 200 | 90.7 |
| IPD080Aap | SEQ ID NO: 201 | 91.4 |
| IPD080Aaq | SEQ ID NO: 202 | 90.7 |
| IPD080Aar | SEQ ID NO: 203 | 90.4 |

TABLE 4-continued

| Identifier | polypeptide | % |
|---|---|---|
| IPD080Aas | SEQ ID NO: 204 | 91.1 |
| IPD080Aat | SEQ ID NO: 205 | 93.4 |
| IPD080Aau | SEQ ID NO: 206 | 93.0 |
| IPD080Aav | SEQ ID NO: 207 | 93.0 |
| IPD080Aaw | SEQ ID NO: 208 | 94.0 |
| IPD080Aax | SEQ ID NO: 209 | 93.4 |
| IPD080Aay | SEQ ID NO: 210 | 93.4 |
| IPD080Aaz | SEQ ID NO: 211 | 93.7 |
| IPD080Ab | SEQ ID NO: 161 | 91.4 |
| IPD080Aba | SEQ ID NO: 212 | 93.7 |
| IPD080Abc | SEQ ID NO: 213 | 90.1 |
| IPD080Abd | SEQ ID NO: 214 | 90.7 |
| IPD080Abe | SEQ ID NO: 215 | 92.1 |
| IPD080Abf | SEQ ID NO: 216 | 91.7 |
| IPD080Abg | SEQ ID NO: 217 | 92.1 |
| IPD080Abh | SEQ ID NO: 218 | 93.4 |
| IPD080Abi | SEQ ID NO: 219 | 93.4 |
| IPD080Abj | SEQ ID NO: 220 | 93.7 |
| IPD080Abk | SEQ ID NO: 221 | 93.0 |
| IPD080Abl | SEQ ID NO: 222 | 92.7 |
| IPD080Abm | SEQ ID NO: 223 | 92.7 |
| IPD080Abn | SEQ ID NO: 224 | 92.4 |
| IPD080Abo | SEQ ID NO: 225 | 92.7 |
| IPD080Abp | SEQ ID NO: 226 | 91.7 |
| IPD080Abq | SEQ ID NO: 227 | 93.0 |
| IPD080Abr | SEQ ID NO: 228 | 91.7 |
| IPD080Abs | SEQ ID NO: 229 | 92.1 |

TABLE 4-continued

| Identifier | polypeptide | % |
|---|---|---|
| IPD080Abt | SEQ ID NO: 230 | 91.4 |
| IPD080Abu | SEQ ID NO: 231 | 92.4 |
| IPD080Abv | SEQ ID NO: 232 | 92.1 |
| IPD080Abw | SEQ ID NO: 233 | 92.1 |
| IPD080Abx | SEQ ID NO: 234 | 92.7 |
| IPD080Aby | SEQ ID NO: 235 | 91.1 |
| IPD080Abz | SEQ ID NO: 236 | 91.4 |
| IPD080Ac | SEQ ID NO: 162 | 91.1 |
| IPD080Aca | SEQ ID NO: 237 | 92.7 |
| IPD080Acb | SEQ ID NO: 238 | 87.4 |
| IPD080Acc | SEQ ID NO: 239 | 87.7 |
| IPD080Acd | SEQ ID NO: 240 | 92.4 |
| IPD080Ace | SEQ ID NO: 241 | 92.1 |
| IPD080Acf | SEQ ID NO: 242 | 93.4 |
| IPD080Acg | SEQ ID NO: 243 | 90.7 |
| IPD080Ach | SEQ ID NO: 244 | 93.7 |
| IPD080Aci | SEQ ID NO: 245 | 91.1 |
| IPD080Acj | SEQ ID NO: 246 | 90.7 |
| IPD080Ack | SEQ ID NO: 247 | 93.7 |
| IPD080Acl | SEQ ID NO: 248 | 92.4 |
| IPD080Acm | SEQ ID NO: 249 | 92.7 |
| IPD080Acn | SEQ ID NO: 250 | 93.4 |
| IPD080Aco | SEQ ID NO: 251 | 93.4 |
| IPD080Acp | SEQ ID NO: 252 | 93.4 |
| IPD080Acq | SEQ ID NO: 253 | 92.4 |
| IPD080Acr | SEQ ID NO: 254 | 94.0 |
| IPD080Acs | SEQ ID NO: 255 | 94.0 |
| IPD080Act | SEQ ID NO: 256 | 93.7 |
| IPD080Acu | SEQ ID NO: 257 | 94.7 |
| IPD080Acv | SEQ ID NO: 258 | 92.4 |
| IPD080Acw | SEQ ID NO: 259 | 92.1 |
| IPD080Acx | SEQ ID NO: 260 | 93.0 |
| IPD080Acy | SEQ ID NO: 261 | 79.5 |
| IPD080Acz | SEQ ID NO: 262 | 79.5 |
| IPD080Ad | SEQ ID NO: 163 | 90.7 |
| IPD080Ada | SEQ ID NO: 263 | 78.8 |
| IPD080Adb | SEQ ID NO: 264 | 79.5 |
| IPD080Adc | SEQ ID NO: 265 | 78.8 |
| IPD080Ade | SEQ ID NO: 266 | 78.5 |
| IPD080Adf | SEQ ID NO: 267 | 82.5 |
| IPD080Adg | SEQ ID NO: 268 | 79.5 |
| IPD080Adh | SEQ ID NO: 269 | 79.8 |
| IPD080Adi | SEQ ID NO: 270 | 80.8 |
| IPD080Adj | SEQ ID NO: 271 | 80.5 |
| IPD080Adk | SEQ ID NO: 272 | 81.1 |
| IPD080Ae | SEQ ID NO: 164 | 94.0 |
| IPD080Af | SEQ ID NO: 165 | 94.7 |
| IPD080Ag | SEQ ID NO: 166 | 94.0 |
| IPD080Ah | SEQ ID NO: 167 | 94.0 |
| IPD080Ai | SEQ ID NO: 168 | 94.0 |
| IPD080Aj | SEQ ID NO: 169 | 93.7 |
| IPD080Ak | SEQ ID NO: 170 | 93.4 |
| IPD080Al | SEQ ID NO: 171 | 93.7 |
| IPD080Am | SEQ ID NO: 172 | 93.4 |
| IPD080An | SEQ ID NO: 173 | 93.7 |
| IPD080Ao | SEQ ID NO: 174 | 93.4 |
| IPD080Ap | SEQ ID NO: 175 | 93.0 |
| IPD080Aq | SEQ ID NO: 176 | 93.4 |
| IPD080Ar | SEQ ID NO: 177 | 93.0 |
| IPD080As | SEQ ID NO: 178 | 93.0 |
| IPD080At | SEQ ID NO: 179 | 93.0 |
| IPD080Au | SEQ ID NO: 180 | 92.4 |
| IPD080Av | SEQ ID NO: 181 | 91.7 |
| IPD080Aw | SEQ ID NO: 182 | 92.1 |
| IPD080Ax | SEQ ID NO: 183 | 92.1 |
| IPD080Ay | SEQ ID NO: 184 | 92.7 |
| IPD080Az | SEQ ID NO: 185 | 92.4 |

TABLE 5

| | IPD080Bb | IPD080Bc | IPD080Bd | IPD080Be | IPD080Bf | IPD080Bg | IPD080Bh | IPD080Bi |
|---|---|---|---|---|---|---|---|---|
| IPD080Ba SEQ ID NO: 273 | 87.4 | 99.7 | 99.7 | 86.8 | 73.8 | 73.4 | 73.4 | 73.4 |
| IPD080Bb SEQ ID NO: 274 | — | 87.1 | 87.4 | 98.7 | 72.5 | 72.5 | 72.1 | 72.1 |
| IPD080Bc SEQ ID NO: 275 | — | — | 99.3 | 86.4 | 73.4 | 73.1 | 73.1 | 73.1 |
| IPD080Bd SEQ ID NO: 276 | — | — | — | 86.8 | 73.8 | 73.4 | 73.4 | 73.4 |
| IPD080Be SEQ ID NO: 277 | — | — | — | — | 71.8 | 71.5 | 71.5 | 71.5 |
| IPD080Bf SEQ ID NO: 278 | — | — | — | — | — | 99.6 | 99.3 | 99.3 |
| IPD080Bg SEQ ID NO: 279 | — | — | — | — | — | — | 98.9 | 98.9 |
| IPD080Bh SEQ ID NO: 280 | — | — | — | — | — | — | — | 98.6 |
| IPD080Bi SEQ ID NO: 281 | — | — | — | — | — | — | — | — |
| IPD080Bj SEQ ID NO: 282 | — | — | — | — | — | — | — | — |
| IPD080Bk SEQ ID NO: 283 | — | — | — | — | — | — | — | — |
| IPD080Bl SEQ ID NO: 284 | — | — | — | — | — | — | — | — |
| IPD080Bm SEQ ID NO: 285 | — | — | — | — | — | — | — | — |
| IPD080Bn SEQ ID NO: 286 | — | — | — | — | — | — | — | — |
| IPD080Bo SEQ ID NO: 287 | | | | | | | | |

| | IPD080Bj | IPD080Bk | IPD080Bl | IPD080Bm | IPD080Bn | IPD080Bo |
|---|---|---|---|---|---|---|
| IPD080Ba SEQ ID NO: 273 | 73.4 | 74.3 | 71.9 | 73.9 | 74.3 | 73.9 |
| IPD080Bb SEQ ID NO: 274 | 72.1 | 73.6 | 71.2 | 73.3 | 73.6 | 73.3 |

TABLE 5-continued

| | | | | | | |
|---|---|---|---|---|---|---|
| IPD080Bc SEQ ID NO: 275 | 73.1 | 73.9 | 71.6 | 73.6 | 73.9 | 73.6 |
| IPD080Bd SEQ ID NO: 276 | 73.4 | 74.3 | 71.9 | 73.9 | 74.3 | 73.9 |
| IPD080Be SEQ ID NO: 277 | 71.5 | 72.9 | 70.6 | 72.6 | 72.9 | 72.6 |
| IPD080Bf SEQ ID NO: 278 | 99.3 | 91.1 | 91.7 | 91.7 | 88.5 | 92.0 |
| IPD080Bg SEQ ID NO: 279 | 98.9 | 90.7 | 91.3 | 91.3 | 88.1 | 91.7 |
| IPD080Bh SEQ ID NO: 280 | 100.0 | 90.7 | 91.3 | 91.3 | 88.1 | 91.7 |
| IPD080Bi SEQ ID NO: 281 | 98.6 | 90.4 | 91.0 | 91.0 | 87.8 | 91.3 |
| IPD080Bj SEQ ID NO: 282 | — | 90.7 | 91.3 | 91.3 | 88.1 | 91.7 |
| IPD080Bk SEQ ID NO: 283 | — | — | 96.2 | 99.3 | 98.6 | 96.6 |
| IPD080Bl SEQ ID NO: 284 | — | — | — | 96.5 | 94.9 | 98.3 |
| IPD080Bm SEQ ID NO: 285 | — | — | — | — | 96.9 | 96.9 |
| IPD080Bn SEQ ID NO: 286 | — | — | — | — | — | 95.3 |
| IPD080Bo SEQ ID NO: 287 | | | | | | |

The percent identity compared to IPD080 Da (SEQ ID NO: 288), based upon the Needleman-Wunsch algorithm, of a selected group of IPD80 Da homologs is shown in Table 6.

TABLE 6

| identifier | polypeptide | % |
|---|---|---|
| IPD080Daa | SEQ ID NO: 314 | 80.1 |
| IPD080Dab | SEQ ID NO: 315 | 66.8 |
| IPD080Dac | SEQ ID NO: 316 | 66.4 |
| IPD080Dad | SEQ ID NO: 317 | 66.1 |
| IPD080Dae | SEQ ID NO: 318 | 66.1 |
| IPD080Db | SEQ ID NO: 289 | 99.3 |
| IPD080Dc | SEQ ID NO: 290 | 98.9 |
| IPD080Dd | SEQ ID NO: 291 | 98.9 |
| IPD080De | SEQ ID NO: 292 | 98.5 |
| IPD080Df | SEQ ID NO: 293 | 86.2 |
| IPD080Dg | SEQ ID NO: 294 | 98.5 |
| IPD080Dh | SEQ ID NO: 295 | 97.8 |
| IPD080Di | SEQ ID NO: 296 | 88.4 |
| IPD080Dj | SEQ ID NO: 297 | 87.3 |
| IPD080Dk | SEQ ID NO: 298 | 88.1 |
| IPD080Dl | SEQ ID NO: 299 | 87.4 |
| IPD080Dm | SEQ ID NO: 300 | 87.7 |
| IPD080Dn | SEQ ID NO: 301 | 87.0 |
| IPD080Do | SEQ ID NO: 302 | 87.4 |
| IPD080Dp | SEQ ID NO: 303 | 87.7 |
| IPD080Dq | SEQ ID NO: 304 | 87.7 |
| IPD080Dr | SEQ ID NO: 305 | 87.4 |
| IPD080Ds | SEQ ID NO: 306 | 87.0 |
| IPD080Dt | SEQ ID NO: 307 | 86.6 |
| IPD080Du | SEQ ID NO: 308 | 87.0 |
| IPD080Dv | SEQ ID NO: 309 | 86.6 |
| IPD080Dw | SEQ ID NO: 310 | 83.0 |
| IPD080Dx | SEQ ID NO: 311 | 82.7 |
| IPD080Dy | SEQ ID NO: 312 | 81.6 |
| IPD080Dz | SEQ ID NO: 313 | 81.9 |

Example 7—Insecticidal Activity Characterization of IPD080 Homologs

Electrocompetent OverExpress™ C41 (DE3) cells (Lucigen) were transformed with each pET vector, containing the respective IPD080 gene insert for recombinant protein expression. Transformed *E. coli* cells were grown overnight at 37° C. with kanamycin selection in 2 milliliters of Luria broth medium. When the cultures reached an optical density of about 0.6, protein expression was induced by adding IPTG to a concentration of 1 mM. Cells were further grown at 16° C. for 16 hours. The cells were collected by centrifugation and lysed in 100 microliters 20 mM Tris pH 8, 300 mM NaCl containing ¼×B-PER II Bacterial Protein Extraction Reagent (Life Technologies) supplemented with Ready-Lyse™ Lysozyme Solution (Epicentre), OmniCleave™ Endonuclease (Epicentre) and Protease Inhibitor Cocktail Set V (EMD Millipore). The lysate was clarified by centrifugation.

Clarified lysates were run in diet bioassays to evaluate the insecticidal proteins insecticidal activity against larvae of European corn borer. Clarified lysates were overlaid onto an agar-based Lepidoptera diet (Southland Products Inc., Lake Village, Ark.) in a 96-well plate format. Four replicates were used per sample. Samples were allowed to dry on top of the diet and two to five neonate insects were placed into each well of the treated plate. After four days of incubation at 27° C. larvae were evaluated for mortality or stunting of growth. Results from bioassays against European corn borer are shown in Table 7. For those homologs not showing activity as cleared lysates expression of the homolog was not confirmed.

TABLE 7

| IPD080 Homolog | Sequence ID | Insecticidal |
|---|---|---|
| IPD080Aa | SEQ ID NO: 160 | + |
| IPD080Aaa | SEQ ID NO: 186 | + |
| IPD080Aab | SEQ ID NO: 187 | + |
| IPD080Aac | SEQ ID NO: 188 | + |
| IPD080Aad | SEQ ID NO: 189 | − |
| IPD080Aae | SEQ ID NO: 190 | + |
| IPD080Aaf | SEQ ID NO: 191 | + |
| IPD080Aag | SEQ ID NO: 192 | + |
| IPD080Aah | SEQ ID NO: 193 | + |
| IPD080Aai | SEQ ID NO: 194 | + |
| IPD080Aaj | SEQ ID NO: 195 | + |
| IPD080Aak | SEQ ID NO: 196 | + |
| IPD080Aal | SEQ ID NO: 197 | + |
| IPD080Aam | SEQ ID NO: 198 | − |
| IPD080Aan | SEQ ID NO: 199 | − |

TABLE 7-continued

| IPD080 Homolog | Sequence ID | Insecticidal |
|---|---|---|
| IPD080Aao | SEQ ID NO: 200 | + |
| IPD080Aap | SEQ ID NO: 201 | + |
| IPD080Aaq | SEQ ID NO: 202 | + |
| IPD080Aar | SEQ ID NO: 203 | + |
| IPD080Aas | SEQ ID NO: 204 | + |
| IPD080Ae | SEQ ID NO: 164 | + |
| IPD080Af | SEQ ID NO: 165 | + |
| IPD080Ag | SEQ ID NO: 166 | + |
| IPD080Ah | SEQ ID NO: 167 | + |
| IPD080Ai | SEQ ID NO: 168 | + |
| IPD080Aj | SEQ ID NO: 169 | + |
| IPD080Ak | SEQ ID NO: 170 | + |
| IPD080Al | SEQ ID NO: 171 | + |
| IPD080Am | SEQ ID NO: 172 | + |
| IPD080An | SEQ ID NO: 173 | − |
| IPD080Ao | SEQ ID NO: 174 | + |
| IPD080Ap | SEQ ID NO: 175 | + |
| IPD080Aq | SEQ ID NO: 176 | + |
| IPD080Ar | SEQ ID NO: 177 | − |
| IPD080As | SEQ ID NO: 178 | + |
| IPD080At | SEQ ID NO: 179 | + |
| IPD080Au | SEQ ID NO: 180 | − |
| IPD080Av | SEQ ID NO: 181 | − |
| IPD080Aw | SEQ ID NO: 182 | + |
| IPD080Ax | SEQ ID NO: 183 | + |
| IPD080Ay | SEQ ID NO: 184 | + |
| IPD080Az | SEQ ID NO: 185 | + |
| IPD080Bb | SEQ ID NO: 274 | − |
| IPD080Bc | SEQ ID NO: 275 | + |
| IPD080Bd | SEQ ID NO: 276 | + |
| IPD080Be | SEQ ID NO: 277 | + |

Example 8—Lepidoptera Insecticidal Assays with Purified IPD080 Homologs

Protein production of IPD080 homologs was performed as described in Example 5. The *E. coli* expressed proteins were purified by immobilized metal ion chromatography using Nickel-NTA resin (Thermo Fisher Scientific) according to the manufacturer's protocols. Purified fractions were loaded onto PD-10 desalting columns (GE Life Sciences, Pittsburgh, USA) pre-equilibrated with 1×PBS buffer. The eluted protein was run in diet assay to evaluate the insecticidal protein effects on larvae of a diversity of Lepidoptera.

Standardized ECB, CEW and/or FAW diet incorporation bioassays were utilized to evaluate the effects of IPD080 proteins on ECB, CEW and/or FAW larvae. For ECB assays 25 ul of a protein sample concentration is mixed with 35 ul of artificial diet per well in a 96 well plate format. There were 3 replicates for each concentration treatment and eight individuals each replicate. One neonate larva (<12 h after hatch) was placed in each assay well. The plates were scored 6 days after initiation of each bioassay and the insect mortality was used to calculate 50 percent inhibitory concentrations (1050) and 50 percent lethal concentrations (LC50) based on probit analysis.

Corn earworm (CEW) (*Helicoverpa zea*) assays were conducted using two concentrations of purified IPD080 protein overlaid onto an agar-based Lepidoptera diet (Southland Products Inc., Lake Village, Ark.) in a 96-well plate format. Four replicates were used per sample. Samples was allowed to dry on top of the diet and two to five neonate insects were placed into each well of the treated plate. After six days of incubation at 27° C. larvae were scored for mortality. The scores were recorded as percent mortality.

FAW diet bioassays were conducted using a dilution series of purified IPD080 protein overlaid onto an agar-based Lepidoptera diet (Southland Products Inc., Lake Village, Ark.) in a 96-well plate format. Samples was allowed to dry on top of the diet and two to five neonate insects were placed into each well of the treated plate. There were 3 replicates for each concentration treatment and eight individuals each replicate. The plates were scored 6 days after initiation of each bioassay and the insect mortality was used to calculate 50 percent inhibitory protein amounts (1050) and 50 percent lethal protein amounts (LC50) based on probit analysis. Results from bioassays of dilution series of His-tagged IPD080 homologs against the Lepidoptera pests: CEW; FAW; and; ECB, are shown in Tables 8, 9 and 10.

TABLE 8

| IPD080 Homologs | | CEW, Overlay, 6d | |
|---|---|---|---|
| Sample | Sequence Id | ug/cm$^2$ | % mortality |
| IPD080Aq | SEQ ID NO: 176 | 121 | 29.2 |
| | | 61 | 17 |
| IPD080As | SEQ ID NO: 178 | 121 | 91.7 |
| | | 61 | 87.5 |
| IPD080Ay | SEQ ID NO: 184 | 121 | 75 |
| | | 61 | 29.2 |
| IPD080Al | SEQ ID NO: 171 | 121 | 75 |
| | | 61 | 29.2 |
| IPD080Aao | SEQ ID NO: 200 | 121 | 29 |
| | | 61 | 8 |
| IPD080Aar | SEQ ID NO: 203 | 121 | 13 |
| | | 61 | 0 |

TABLE 9

| Homologs | | FAW, Overlay, 6d | |
|---|---|---|---|
| Sample | | | ug/cm$^2$ |
| IPD080Aq | SEQ ID NO: 176 | LC50 | 9.48 |
| | | IC50 | 7.8 |
| IPD080As | SEQ ID NO: 178 | LC50 | 4.07 |
| | | IC50 | 3.23 |
| IPD080Ay | SEQ ID NO: 184 | LC50 | 9.86 |
| | | IC50 | 8.53 |
| IPD080Al | SEQ ID NO: 171 | LC50 | 11.02 |
| | | IC50 | 9.39 |
| IPD080Aao | SEQ ID NO: 200 | LC50 | 15.76 |
| | | IC50 | 10.75 |
| IPD080Aar | SEQ ID NO: 203 | LC50 | 9.72 |
| | | IC50 | 7.89 |

TABLE 10

| Homolog | | ECB, Diet Incorp, 6d | | |
|---|---|---|---|---|
| Sample | | LC/IC | ppm | 95% CL |
| IPD080Aaf | SEQ ID NO: 191 | LC50 | 83.5 | 13.9-500 |
| | | IC50 | 4.79 | 2.98-7.23 |
| IPD080Aal | SEQ ID NO: 197 | LC50 | 99.7 | 65.8-176 |
| | | IC50 | 20.1 | 12.8-29.8 |
| IPD080Ap | SEQ ID NO: 175 | LC50 | ~79 | |
| | | IC50 | 16.3 | 11.66-27.26 |
| IPD080Aq | SEQ ID NO: 176 | LC50 | 112 | 86.3-146 |
| | | IC50 | 37.5 | 28.0-46.9 |
| IPD080As | SEQ ID NO: 178 | LC50 | ~25 | |
| | | IC50 | <25 | |
| IPD080Ay | SEQ ID NO: 184 | LC50 | >400 | |
| | | IC50 | 57.3 | 46.6-70.0 |
| IPD080Al | SEQ ID NO: 171 | LC50 | 64.3 | 37.4-87.4 |
| | | IC50 | 21 | 7.42-29.3 |
| IPD080Aao | SEQ ID NO: 200 | LC50 | 242 | 161-490.1 |
| | | IC50 | 27 | 13.8-37.5 |
| IPD080Aar | SEQ ID NO: 203 | LC50 | 150 | 35.78-70.1 |
| | | IC50 | 21 | 10.24-19.29 |

Example 9—Lack of Cross Resistance of IPD080 Homologs in Cry1A-Resistant and Cry1F-Resistant European Corn Borer (ECB) and Cry1F-Resistant Fall Armyworm (FAW)

To determine if Cry1 Ab and Cry1F resistant insects were cross resistant to IPD080 homolog samples, European corn borer (ECB, *Ostrinia nubilalis*) larvae susceptible or resistant to Cry1 Ab (RR>500; Crespo A. et al., *Pest Manag Sci* 65: 1071-1081, 2009) or Cry1F (RR>50,000; Siegfried B. et al., *Pest Manag Sci* 70: 725-733, 2014), were treated with IPD080Aaf (SEQ ID NO: 191) and IPD080Aq (SEQ ID NO: 176). A field-derived Cry1F-resistant strain (Cry1F-R) of fall armyworms (FAW, *Spodoptera fruoperda*) (RR>300; Alves, A, US 2012/0148497 A1, 2012) was treated with IPD080Aq (SEQ ID NO: 176).

Standardized ECB and FAW diet incorporation bioassays were utilized to evaluate the effects of IPD080Aaf (SEQ ID NO: 191) and IPD080Aq (SEQ ID NO: 176) on ECB and/or FAW larvae. Briefly, 25 ul of a protein sample concentration is mixed with 75 ul of artificial diet per well in a 96 well plate format. There were 3 replicates for each concentration treatment and eight individuals each replicate. One neonate larva (<12 h after hatch) was placed in each assay well. The plates were scored 6 days after initiation of each bioassay and the insect mortality was used to calculate 50 percent lethal concentrations (LC50) based on probit analysis. The resistance ratio (RR) was calculated as follows: RR=(LC50 of resistant insects)/(LC50 of susceptible insects). As shown in Table 11 Cry1A- and Cry1F-resistant ECB insects were susceptible to IPD080Aaf (SEQ ID NO: 191) and IPD080Aq (SEQ ID NO: 176). Cry1F resistant FAW insects were susceptible to IPD080Aq (SEQ ID NO: 176). The results suggested no cross-resistance to IPD080Aaf (SEQ ID NO: 191) or IPD080Aq (SEQ ID NO: 176).

TABLE 11

| Sample | Insect & colony | LC50 (ppm), 6d | 95% CL | Res Ratio (RR) |
|---|---|---|---|---|
| IPD080Aaf (SEQ ID NO: 191) | ECB susceptible | 46.10 | 9.3-372 | |
| | ECB Cry1A-resistant | 49.06 | 36-67 | 1.1 |
| | ECB Cry1F-resistant | 28.16 | 19-42 | 0.61 |
| IPD080Aq (SEQ ID NO: 176) | ECB susceptible | ~100 | | |
| | ECB Cry1A-resistant | 71.51 | 50-125 | 0.72 |
| | ECB Cry1F-resistant | 89.96 | 58-155 | 0.90 |
| IPD080Aq (SEQ ID NO: 176) | FAW susceptible | 179.2 | 141-228 | |
| | FAW Cry1F-resistant | 97.8 | 75-133 | 0.55 |

Example 10—Mode of Action

The IPD080 homolog, IPD080Aaf (SEQ ID NO: 191), was evaluated for stability in the presence of midgut fluid extracts from ECB to determine if its full length state represents a pro-form of the protein and whether midgut proteolysis is required for activation to a toxic state in vivo.

To understand the mechanism of IPD080Aaf (SEQ ID NO: 191) toxicity, specific binding of purified IPD080Aaf protein (SEQ ID NO: 191) with ECB midgut tissue was evaluated by in vitro competition assays. Midguts were isolated from 4th instar ECB larvae to prepare brush border membrane vesicles (BBMV) following a method modified from Wolfersberger et al. (1987). BBMVs represent the apical membrane component of the epithelial cell lining of insect midgut tissue and therefore serve as a model system for how insecticidal proteins interact within the gut following ingestion.

Recombinant IPD080Aaf (SEQ ID NO: 191) was expressed and purified from an *E. coli* expression system utilizing a carboxy-terminal 10×-histidine tag fusion. The full length purified protein was cleaved with trypsin, purified by anion exchange chromatography, labeled with Alexa-Fluor® 488 (Life Technologies) and unincorporated fluorophore was separated from labeled protein by dialysis. Prior to binding experiments, proteins were quantified by gel densitometry following Simply Blue® (Thermo Scientific) staining of SDS-PAGE resolved samples that included BSA as a standard. Trypsin processing of the full-length toxin reduced the size of the protein from 35 kDa to ~30kD to simulate processing that occurs in the presence of gut fluid.

Binding buffer consisted of 50 mM sodium carbonate pH 9.6, 150 mM sodium chloride and 0.1% Tween® 20 with the addition of 2× Complete, EDTA-free protease inhibitor cocktail (Roche). To demonstrate specific binding and to evaluate affinity, 20 mg BBMVs were incubated with 10 nM Alexa-labeled IPD080Aaf (SEQ ID NO: 191) in 100 μL of binding buffer for 1 hour at RT in the absence and presence of increasing concentrations of unlabeled IPD080Aaf (SEQ ID NO: 191). Centrifugation at 20000×g was used to pellet the BBMVs to separate unbound toxin remaining in solution. The BBMV pellet was then washed twice with binding buffer to remove unbound toxin. The final BBMV pellet (with bound fluorescent toxin) was solubilized in reducing Laemmli sample buffer, heated to 100° C. for 10 minutes, and subjected to SDS-PAGE using 4-12% Bis-Tris polyacrylamide gels (Life Technologies). The amount of Alexa-labeled IPD080Aaf (SEQ ID NO: 191) in the gel from each sample was measured by a digital fluorescence imaging system (Typhoon FLA 9500, GE Healthcare). Digitized images were analyzed by densitometry software (Phoretix 1D, TotalLab, Ltd.)

Figure 6:
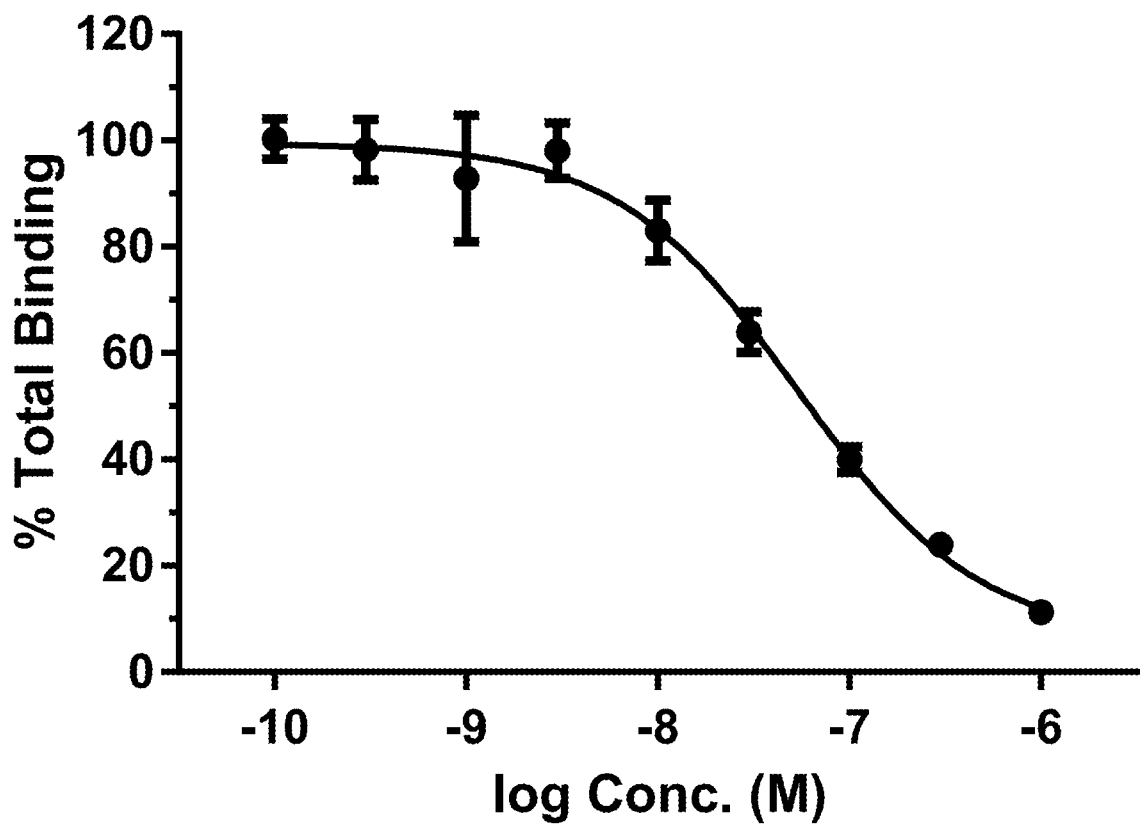
FIG. 6 shows a curve reflecting densitometry values of in-gel fluorescence, from the SDS-PAGE gel of Example 10, for homologous competition of 25 nM IPD103Aa$^{Alexa}$ binding to *Helicoverpa zea* (Corn Earworm) BBMV tide of PCT Publication Number WO2015/023846, a PIP-72 polypeptide of PCT Publication Number WO2015/038734; a PtIP-50 polypeptide and a PtIP-65 polypeptide of PCT Publication Number WO2015/120270; a PtIP-83 polypeptide of PCT Publication Number WO2015/120276; a PtIP-96 polypeptide of PCT Serial Number PCT/US15/55502; an IPD079 polypeptide of U.S. Ser. No. 62/201,977; an IPD082 polypeptide of U.S. Ser. No. 62/269,482, and δ-endotoxins including, but not limited to, the Cry1, Cry2, Cry3, Cry4, Cry5, Cry6, Cry7, Cry8, Cry9, Cry10, Cry11, Cry12, Cry13, Cry14, Cry15, Cry16, Cry17, Cry18, Cry19, Cry20, Cry21, Cry22, Cry23, Cry24, Cry25, Cry26, Cry27, Cry28, Cry29, Cry30, Cry31, Cry32, Cry33, Cry34, Cry35, Cry36, Cry37, Cry38, Cry39, Cry40, Cry41, Cry42, Cry43, Cry44, Cry45, Cry46, Cry47, Cry49, Cry50, Cry51, Cry52, Cry53, Cry54, Cry55, Cry56, Cry57, Cry58, Cry59, Cry60, Cry61, Cry62, Cry63, Cry64, Cry65, Cry66, Cry67, Cry68, Cry69, Cry70, Cry71, and Cry72 classes of δ-endotoxin genes and the *B. thuringiensis* cytolytic cyt1 and cyt2 genes. Members of these classes of *B. thuringiensis* insecticidal proteins well known to one skilled in the art (see, Crickmore Cry1I & Cry1E (US2012/0324605); Cry34Ab/35Ab and Cry6Aa (US20130167269); Cry34Ab/VCry35Ab & Cry3Aa (US20130167268); and Cry3A and Cry1Ab or Vip3Aa (US20130116170). Pesticidal proteins also include insecticidal lipases including lipid acyl hydrolases of U.S. Pat. No. 7,491,869, and cholesterol oxidases such as from *Streptomyces* (Purcell et al. (1993) *Biochem Biophys Res Commun* 15:1406-1413). Pesticidal proteins also include VIP (vegetative insecticidal proteins) toxins of U.S. Pat. Nos. 5,877,012, 6,107,279 6,137,033, 7,244,820, 7,615,686, and 8,237,020 and the like. Other VIP proteins are well known to one skilled in the art (see, lifesci.sussex.ac.uk/home/Neil_Crickmore/Bt/vip.html which can be accessed on the world-wide web using the "www" prefix). Pesticidal proteins also include toxin complex (TC) proteins, obtainable from organisms such as *Xenorhabdus*, *Photorhabdus* and *Paenibacillus* (see, U.S. Pat. Nos. 7,491,698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus*, *Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptB1Xb and XptC1Wi. Examples of Class C proteins are TccC, XptC1Xb and XptB1Wi. Pesticidal proteins also include spider, snake and scorpion venom proteins. Examples of spider venom peptides include but not limited to lycotoxin-1 peptides and mutants thereof (U.S. Pat. No. 8,334,366).

The apparent affinity of IPD080Aaf (SEQ ID NO: 191) for ECB BBMVs was estimated based on the concentration of unlabeled protein that was needed to reduce the binding of Alexa-labeled IPD080Aaf (SEQ ID NO: 191) by 50% ($EC_{50}$ value). This value was approximately 54 nM for IPD080Aaf (SEQ ID NO: 191) binding with ECB BBMVs (FIG. 6).

Example 11—*Agrobacterium*-Mediated Transient Expression of IPD080 Homologs in Bean To confirm activity of IPD080Aa (SEQ ID NO: 2) and selected homologs (Table 12) the corresponding genes were cloned into a transient expression system under control of the viral promoter dMMV (Dey, et. al., (1999) *Plant Mol. Biol.* 40:771-782). The *Agrobacterium* strains containing each of the constructs were infiltrated into leaves. The agro-infiltration method of introducing an *Agrobacterium* cell suspension to plant cells of intact tissues so that reproducible infection and subsequent plant derived transgene expression may be measured or studied is well known in the art (Kapila, et. al., (1997) *Plant Science* 122:101-108). Briefly, the unifoliate leaves of bush bean (common bean, *Phaseolus vulgaris*) were agro-infiltrated with normalized bacterial cell cultures of test and control strains. Leaf discs were excised from each plantlet and infested with 2 neonates of Corn Earworm, (CEW, *Helicoverpa zea*), or Fall Armyworm (*Spodoptera frugiperda*, FAW). Leaf discs from a control were generated with *Agrobacterium* containing only empty expression vector. Leaf discs from a non-infiltrated plant were used as a second control. The consumption of the leaf tissue was scored three days after infestation and given scores of 0 to 9. The transiently expressed IPD080Aa (SEQ ID NO: 160) and homologs protected bush bean leaf discs from consumption by the infested insects while total green tissue consumption was observed for the negative control and untreated tissue. Transient protein expression of IPD080Aa (SEQ ID NO: 160) and homologues was confirmed by a mass spectrometry-based protein identification method using extracted protein lysates from infiltrated leave tissues (Patterson, (1998) 10(22):1-24, Current Protocol in Molecular Biology published by John Wiley & Son Inc). the insecticidal activity of selected IPD103 polypeptides, transiently expressed in bush bean, against leaf feeding damage from a selection of Lepidoptera is shown in Table 12.

TABLE 12

| Name | SEQ ID NO | IPD080 Protein Con. (ppm) | FAW Score | CEW Score |
|---|---|---|---|---|
| IPD080Aa | SEQ ID NO: 160 | 7682 | 6.5 | 5.9 |
| IPD080Aaa | SEQ ID NO: 186 | 951 | 6.8 | 4.5 |
| IPD080Aab | SEQ ID NO: 187 | 789 | 5.5 | 1.8 |
| IPD080Aac | SEQ ID NO: 188 | 2623 | 2.3 | 2.8 |
| IPD080Aae | SEQ ID NO: 190 | 12163 | 2.3 | 3.3 |
| IPD080Aag | SEQ ID NO: 192 | 8278 | 6.3 | 2.8 |
| IPD080Aah | SEQ ID NO: 193 | 9423 | 2.0 | 3.5 |
| IPD080Aai | SEQ ID NO: 194 | 2520 | 5.3 | 2.5 |
| IPD080Aaj | SEQ ID NO: 195 | 3598 | 8.0 | 1.3 |

TABLE 12-continued

| | | | | |
|---|---|---|---|---|
| IPD080Aak | SEQ ID NO: 196 | 4689 | 1.0 | 3.3 |
| IPD080Aam | SEQ ID NO: 198 | 6175 | 6.3 | 6.3 |
| IPD080Aao | SEQ ID NO: 200 | 2627 | 7.0 | 5.3 |
| IPD080Aap | SEQ ID NO: 201 | 4762 | 8.5 | 7.5 |
| IPD080Aaq | SEQ ID NO: 202 | 3207 | 6.0 | 3.0 |
| IPD080Aar | SEQ ID NO: 203 | 46783 | 7.0 | 5.5 |
| IPD080Aas | SEQ ID NO: 204 | 4366 | 6.8 | 1.5 |
| IPD080Aj | SEQ ID NO: 169 | 1507 | 5.8 | 2.5 |
| IPD080Ak | SEQ ID NO: 170 | 1154 | 5.0 | 5.0 |
| IPD080Al | SEQ ID NO: 171 | 2022 | 6.0 | 5.8 |
| IPD080Am | SEQ ID NO: 172 | 952 | 7.0 | 2.0 |
| IPD080An | SEQ ID NO: 173 | 2700 | 5.3 | 3.3 |
| IPD080Ao | SEQ ID NO: 174 | 1184 | 6.5 | 1.8 |
| IPD080Ar | SEQ ID NO: 177 | 5696 | 5.5 | 6.3 |
| IPD080As | SEQ ID NO: 178 | 4090 | 6.0 | 4.5 |
| IPD080At | SEQ ID NO: 179 | 8194 | 7.0 | 2.5 |
| IPD080Au | SEQ ID NO: 180 | 3659 | 1.0 | 2.5 |

TABLE 12-continued

| | | | | |
|---|---|---|---|---|
| IPD080Ax | SEQ ID NO: 183 | 20210 | 6.8 | 5.5 |
| IPD080Ay | SEQ ID NO: 184 | 6882 | 6.8 | 7.0 |
| IPD080Bb | SEQ ID NO: 274 | 2041 | 2.3 | 1.0 |
| IPD080Bc | SEQ ID NO: 275 | 9748 | 6.3 | 4.0 |
| IPD080Bd | SEQ ID NO: 276 | 4151 | 6.8 | 3.5 |
| IPD080Be | SEQ ID NO: 277 | 1975 | 3.5 | 1.0 |

| Leaf Feeding Score | % Consumed |
|---|---|
| 1 | 86-100 |
| 2 | 71-85 |
| 3 | 61-70 |
| 4 | 51-60 |
| 5 | 36-50 |
| 6 | 11-35 |
| 7 | 11-36 |
| 8 | 1-3 |
| 9 | 0 |

Example 12—Identification of IPD080Aa Homologs

Additional IPD080Aa polypeptide homologs were identified as described in Example 6. The IPD080Aa homologs and the organism from which they were identified are shown in Table 13.

TABLE 13

| Gene Name | Source | Organism | polynucleotide | polypeptide |
|---|---|---|---|---|
| IPD080_050282.10 | ES0001 | *Huperzia carriata* | SEQ ID NO: 355 | SEQ ID NO: 326 |
| IPD080_020484.5 | ES0001 | *Huperzia carriata* | SEQ ID NO: 356 | SEQ ID NO: 327 |
| IPD080_25324.3 | ES0004 | *Huperzia tetratoides* | SEQ ID NO: 357 | SEQ ID NO: 328 |
| IPD080_034551.3 | ES0005 | *Huperzia squarrosa* | SEQ ID NO: 358 | SEQ ID NO: 329 |
| IPD080_034551.1 | ES0005 | *Huperzia squarrosa* | SEQ ID NO: 359 | SEQ ID NO: 330 |
| IPD080_025118.2 | LW9143 | *Huperzia obtusifolia* | SEQ ID NO: 360 | SEQ ID NO: 331 |
| IPD080_044525.2 | LW9143 | *Huperzia obtusifolia* | SEQ ID NO: 361 | SEQ ID NO: 332 |
| IPD080_044527.2 | LW9143 | *Huperzia obtusifolia* | SEQ ID NO: 362 | SEQ ID NO: 333 |
| IPD080_044529.2 | LW9143 | *Huperzia obtusifolia* | SEQ ID NO: 363 | SEQ ID NO: 334 |
| IPD080_052486.1 | LW9143 | *Huperzia obtusifolia* | SEQ ID NO: 351 | SEQ ID NO: 335 |
| IPD080_052488.1 | LW9143 | *Huperzia obtusifolia* | SEQ ID NO: 352 | SEQ ID NO: 336 |
| IPD080_060435.1 | LW9143 | *Huperzia obtusifolia* | SEQ ID NO: 364 | SEQ ID NO: 337 |
| IPD080_021615 | NY114 | *Huperzia lucidula* | SEQ ID NO: 346 | SEQ ID NO: 338 |
| IPD080_47745 | NY114 | *Huperzia lucidula* | SEQ ID NO: 347 | SEQ ID NO: 339 |
| IPD080_061534 | NY114 | *Huperzia lucidula* | SEQ ID NO: 348 | SEQ ID NO: 340 |
| IPD080_003064.1 | NY123 | *Diphasiastrum tristachyum* | SEQ ID NO: 349 | SEQ ID NO: 341 |
| IPD080_012222.2 | NY123 | *Diphasiastrum tristachyum* | SEQ ID NO: 350 | SEQ ID NO: 342 |
| IPD080_000143.4 | LW11487 | *Huperzia carinata* | SEQ ID NO: 353 | SEQ ID NO: 343 |
| IPD080_040523 | LW9141AF | *Huperzia salvinioides* | SEQ ID NO: 354 | SEQ ID NO: 344 |
| IPD080_015057 | LW9173CF | *Lycopodium* species | SEQ ID NO: 365 | SEQ ID NO: 345 |

Example 13—Structural Modeling of IPD080Aa and Homologs Thereof

Sequence analysis suggested that the IPD080Aa polypeptide (SEQ ID NO: 160) belongs to aerolysin protein superfamily. Simple BLAST® search against the non-redundant database of National Center for Bioinformatics information (NCBI), showed 37% identity and 57% similarity (Evalue of 3e-42 over full length match) to an ETX toxin (SFT67860.1). A profile (Pfam) search using HMMER software program revealed that the IPD080Aa polypeptide (SEQ ID NO: 160) best match was Aerolisin/ETX pore-forming domain with an Evalue of 1.8e-15 (Eddy S. R., Bioinformatics, 14:755-763, 1998). In a profile-profile search against PDB70_hhm (a profile database) using HHsearch software program (Soding, *Bioinformatics*. 21 (7): 951-960, 2005), all the top hits with Probability Score >95% are aerolysin-like proteins including parasporin-2 toxin, Cry23Aa1, and Cry51Aa1 from *Bacillus thuringiensis*, *Clostridium perfringens* epsilon toxin, zebrafish natterin-like protein, hemolytic lectin from mushroom *Laetiporus sulphureus*, aerolysin from *Aeromonas hydrophila*, and earth worm lysenin. Aerolysin superfamily consists of proteins from all branches of life some with an extremely high sequence divergence, but all the members seem to share a common aerolysin core structural fold and a similar pore-forming mechanism (Szczesny et al., *PLOS ONE*, 6, p. e20349. 2011). Generally, aerolysin-like toxins are first produced in a protoxin form as a water-soluble protein, then migrate and subsequently bind receptors on their target cell membrane; following proteolytic activation, they form circular arc-like oligomers that, in turn, insert into and perforate the plasma membrane, causing content leaking and potentially leading to cell death. The most conserved sequence region of aerolysin family is the membrane inserting domain with a β-barrel topology. To distinguish it from another type of a helix pore-forming toxin (α-PFT), aerolysin-like protein is often referred to as β-PFT.

Figure 7:
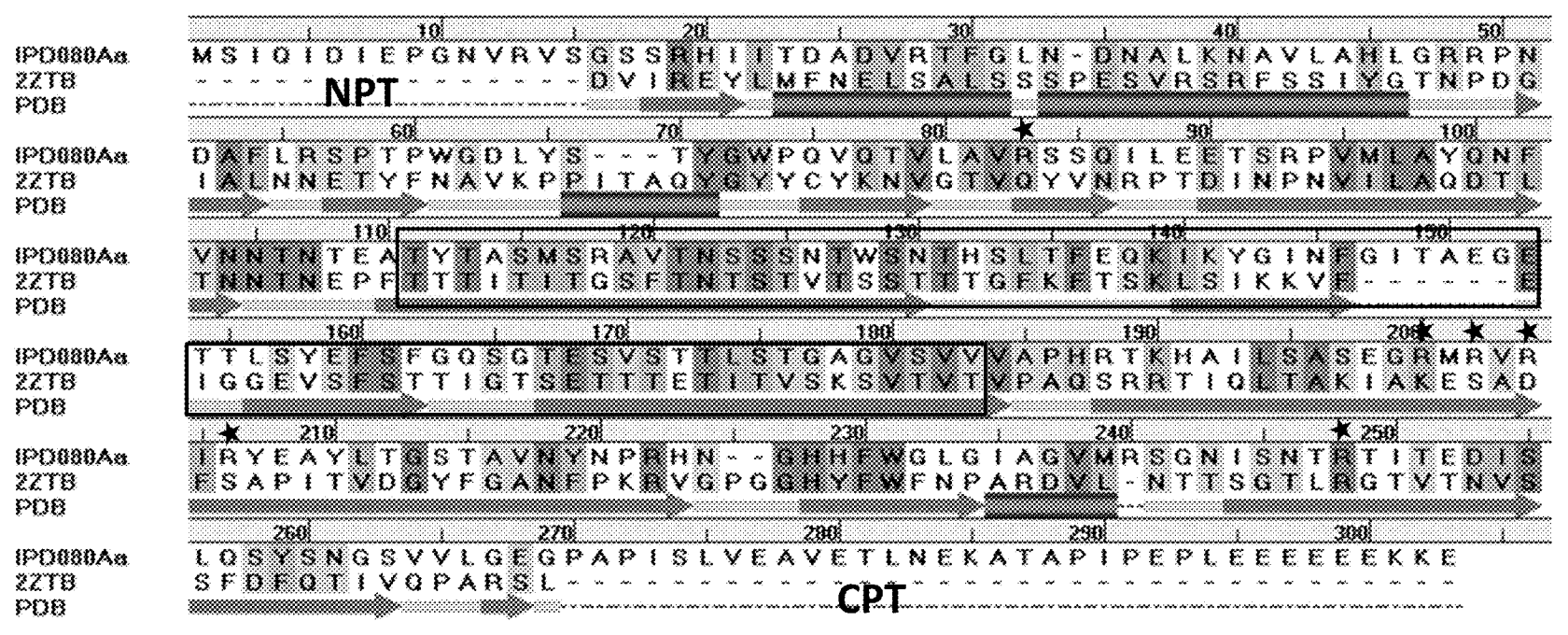

The structures of the IPD080Aa polypeptide (SEQ ID NO: 160) active monomer and oligomeric pore were modeled using standard homology modeling techniques available within the Discovery Studio 2016, software. (Copyright 2005-12 Accelrys Software). To identify a modeling template, the IPD080Aa polypeptide sequence (SEQ ID NO: 160) was used as the query sequence to search against the available structures in the Protein Databank (PBD) with SSearch36 software program. The top hit was parasporin-2 from *Bacillus thuringiensis* (PDB ID 2ztb) with low similarity, E-value of 2.94e-4 and 25% identity covering 208 residues out of the query sequence (297aa). Profile-profile HHSearch software program was used to confirm the alignment. The IPD080Aa polypeptide (SEQ ID NO: 160) and its known homologues were first used to obtain more related sequences of larger diversity against UNIProt20 using the HHblits software program (Soding, *Bioinformatics*. 21 (7): 951-960, 2005). The resulting sequences were aligned together and profiled, and the predicted secondary structure elements were added to the IPD080Aa profile. The resulting profile was used as query to search PDB70_hhm profile database with HHSearch software program. The top hit was again 2ztb with a significant E-value of 4.5e9-93 covering the query sequence from residue 22 to 263. The 2ztb, an active form of parasporin-2 (Akiba, et. al., *J Mol Biol* 386: 121-133, 2009) after proteolytic cleavage of both the N-terminal peptide (NW) and C-terminal peptide (CTP), was used as the structural template for the IPD080Aa polypeptide (SEQ ID NO: 160) modeling. The modeling sequence alignment of the IPD080Aa polypeptide (SEQ ID NO: 160) to 2ztb as the template was constructed on Discovery Studio 2016 with manual adjustments per the pairwise and profile-profile alignments and structural integrity (FIG. 7). Beyond the aligned active toxin domain (17-263), the IPD080Aa polypeptide (SEQ ID NO: 160) has both a N-terminal peptide, residues 1-16 (NTP), and C-terminal peptide, residues—264-297 (CTP), respectively. The active domain's 3D structure model was built based on 2ztb. During the homology modeling procedure 20 models for the IPD080Aa polypeptide (SEQ ID NO: 160) were generated, energy minimized with high optimization setting (Discovery Studio 20160)) and scored. The lowest energy model was used in the following structural analysis of the IPD080Aa polypeptide (SEQ ID NO: 160).

Figure 8:
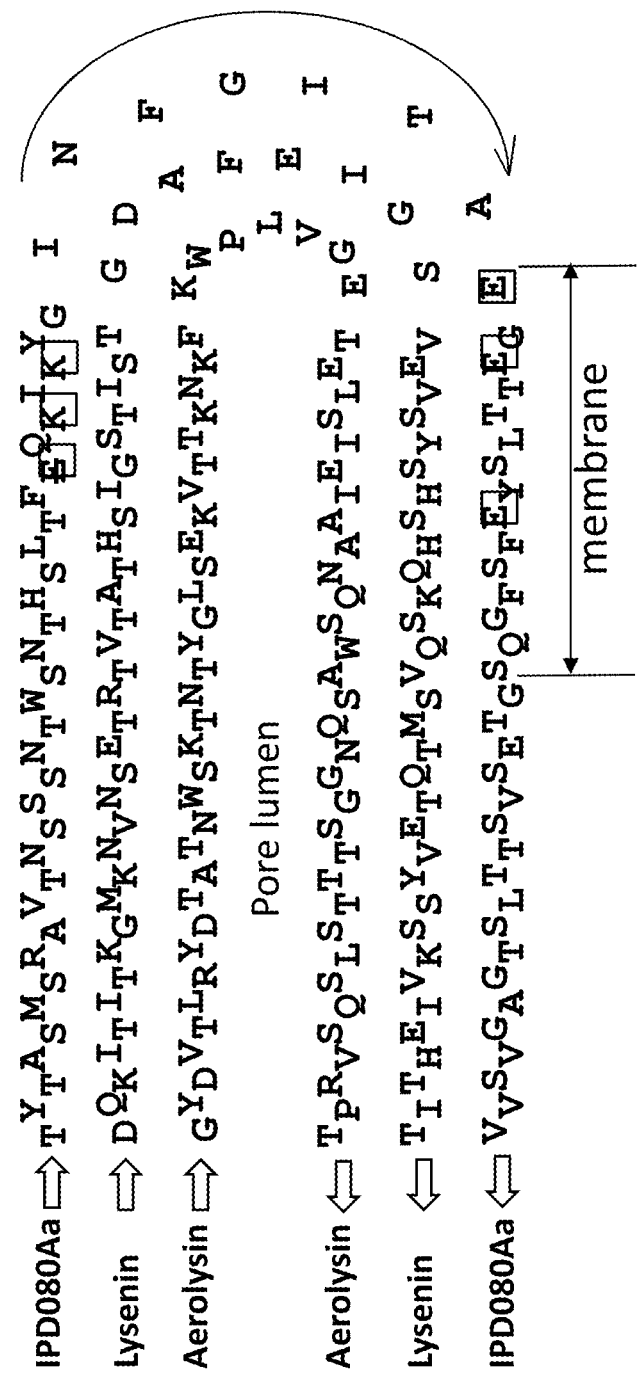
Figure 10B:
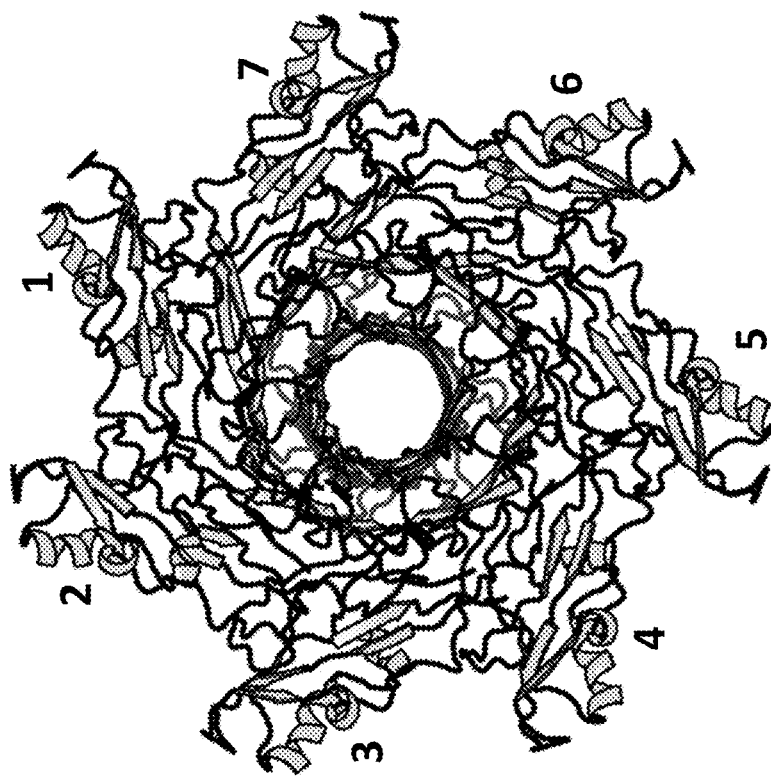
Figure 10A:
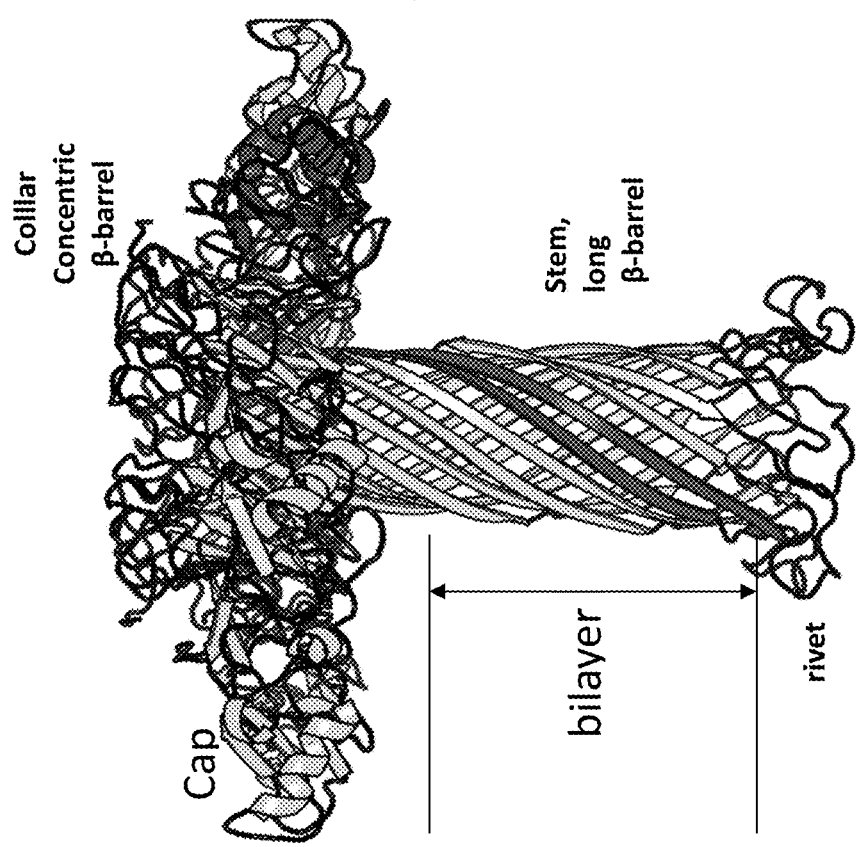

The model of the IPD080Aa polypeptide (SEQ ID NO: 160) shares a high degree of similarity with the parasporin-2 structure (2ztb) at the overall architecture level and all the well-defined secondary structure elements, but significant differences are observed in several structural elements including an extension of the loop spanning β7 and β8 and a truncation of loop linking 1310-1311 (Akiba et al., *J Mol Biol* 386: 121-133, 2009). The IPD080Aa polypeptide (SEQ ID NO: 8) topography is an elongated shape with a dimension of approximately 110 Å×18 Å×26 Å dominated by long β-strands. Like known aerolysin structures such as s-toxin (PDB:1uyj, Cole et al., *Nat Struct Mol Biol* 11: 797-798, 2004) or aerolysin (1pre, Rossjohn et al., J. Struct. Biol., 121, pp. 92-100, 1998), the most striking feature is that a long pair of serial loop-linked β strand hairpin (β5-β6-β7 ... β8-β9-β10) runs up and down along the protein long axis with two turning points at β5-β6 along with β9-β10 and β6-β7 along with β8-β9 (FIG. 8, FIG. 9A). According to aerolysin-like protein convention, the overall structure can be divided into three domains along its long axis, α/β Domain I and anti-parallel β-sheet Domain II and β-sandwich Domain Ill. Consistent with the sequence comparison (Szczesny et al., *PLoS ONE*, 6, p. e20349, 2011), Domain II and Ill are highly similar to other aerolysin members while Domain I is only similar to the closely related members such as ε-toxin but distinct from others. Domain I is comprised of residues 17-76 and 204-240 of the IPD080Aa polypeptide (SEQ ID NO: 160) (FIG. 9A). The structure of Domain I consists of three α-helices and a broken anti-parallel β-sheet with three short strands (β3-β2-β11) and the top portion of strand β10 at top and three strands (β1-β4-β10) at bottom. Domain II is a five-stranded anti-parallel β-sheet (β5a-β10-β12-β6-β9) with an amphipathic β-hairpin β7-β8 patching on one side. The β-hairpin β7-β8 is too thin to cover the whole inner surface, leaving a hydrophobic gap between β5a and β7. The gap provides a proper space for docking NTP. The same five β-strands of Domain II extend and refold into a beta-sandwich, Domain made by two sheets, a 3-stranded sheet (β5-β10-β12) and a 2-stranded sheet (β6-β9).

The pore structures of aerolysin 5jzh (Iacovache et al., *Nat Commun* 7:12062, 2016) and lysenin 5ec5 (Podobnik et al., *Nature Communications*, 7:11598, 2016) were used to model the pore structure of IPD080Aa polypeptide (SEQ ID NO: 160). The profile-profile matches aligned the IPD080Aa polypeptide (SEQ ID NO: 160) to 5jzh covering query sequence of amino acids 84-212 with Probability of 99% and E-value of 9.4e-12, and to 5ec5 from amino acids 96-205 with Probability of 95% and E-value of 0.95. The aligned sequence spans the most conserved motif in aerolysin, the long pore lining 3-hairpin. Aerolysin and lysenin pores have a very similar pore stem, cap, and overall architecture, but they have distinct oligomeric stoichiometry, heptameric and nonameric pore for aerolysin and lysenin, respectively. Based on the similarity to aerolysin, the IPD080Aa polypeptide (SEQ ID NO: 160) pore was modeled as a heptamer, the smallest number required for the pore closure, but higher oligomeric pore might also exist in some fraction. The pore stem 3-hairpin model was built based on the sequence alignment generated by HHSearch software program with manual adjustments (FIG. 81) while the cap region involving Domain I and III was manually constructed in reference of the available pore structures. The resulting model exhibits an elegant mushroom-like structure suitable for plasma membrane insertion and permeabilization. The pore consists of stem, cap, collar, and rivet. Surprisingly, the pore channel is extraordinarily long of approximately 100 Å long and approximately 16 Å wide in the inner diameter, much longer than needed to penetrate the approximately 30 Å plasma membrane. The long stem barrel is composed of 14 anti-parallel 3 strands from 7 protomer 3-hairpins. Compared to the monomer structure, the stem 3-hairpin (residues 108-180 of SEQ ID NO: 160) results from straightening of β6 and β7 along with β9 and β8. Due to the pore formation, the monomer's Domain II is disbanded with β6-β7-β9-β8 forming the pore stem while β5-β10-β12 becoming inner rim of the cap. Besides part of Domain II, the cap region is mainly composed of the Domain I without significant conformation change from monomer. The Domain III also preserves its structure but aligns with other 6 molecules side-by-side circularly, forming a concentric double layered β-barrel with the inner layer having 14 strands while the outer layer having 21 strands. This concentric β-barrel might enhance the pore stability significantly. The rivet is made of the β hairpin tip to anchor the pore in the plasma membrane.

The structural modeling of both the monomer and pore of IPD080Aa polypeptide (SEQ ID NO: 160) revealed features likely involved in its function; (1) the pore lumen lined with mostly Threonine and Serine residues, with their small hydrophilic side chains, which likely facilitate substrate passing through the channel (FIG. 7); (2) four negatively charged residues E133, E147, E149, and E155 and two positively charged K135 and K137 at the channel entrance, which are believed to be specificity determinates of the passage substrate; (3) the mostly hydrophobic amino acids membrane contact residues including H128, L130, F132, Q134, I136, Y138, I140, F142, I144, A146, G148, T150, L152, Y154, F156, and F158 on the β7-β8 hairpin (FIG. 8); (4) the aromatic amino acid cluster in Domain I surface including W60, Y64, Y67, W69, Y215, H222, H223, F224, and W225 in a position to interact with membrane-anchored receptors in the pore structure; (5) the Arginine cluster of R79, R196, R198, R200, R202, and R242 on the outer face of Domain II of the monomer central β-sheet (FIGS. 7 & 11) relocated underneath the oligomeric pore cap (FIG. 10), which is suitable to interact with membrane phosphate groups and may serve as the initial contact point with the membrane as a monomer and reinforce the functional pore anchoring on the membrane in oligomer.

Like aerolysin, IPD080Aa has both a NTP and a CTP, and these peptides are likely serving inhibition elements to prevent the pro-toxin from early pore formation. The proteolytic cleavage of NTP and CTP is believed to be required for toxin activation. The template crystal structure of PS2 lacks an NTP and a CTP. Based on the IPD080Aa model, secondary structure prediction, and other aerolysin-like structures, the conformation of the NTP and the CTP was determined. The 16 residue NTP with an alternating hydrophobic/hydrophilic pattern (Met-Ser-He-Gln-He-Asp-He-Glu-Pro (amino acids 1-9 of SEQ ID NO: 160)—hydrophobic residues underlined) could assume a β-strand structure to patch the hydrophobic gap between β7 and β5 (FIG. 11). This arrangement could lock the β-hairpin and prevent it from pore formation. The CTP is believed to seal the sticky β-barrel edge of Domain III to avoid aggregation required for pre-pore formation. The IPD080Aa polypeptide (SEQ ID NO: 160) has a polyE tail at the end of the CTP, which based on structural relationship is in a vicinity to interact with the Arginine cluster at Domain II, neutralizing the positively charged Arginine residues (FIG. 11).

It should be understood that while the specific residue numbers referred to herein with respect to the structural model relate primarily to the exemplified IPD080Aa polypeptide (SEQ ID NO: 160), one skilled in the art would know, with the benefit of this disclosure, corresponding residues and segments are now identifiable in the other IPD080 polypeptides of the disclosure. The exact numbering of the residues might not strictly correspond to the IPD080Aa polypeptide (SEQ ID NO: 160), but the corresponding residues are readily identifiable considering the subject disclosure. See, e.g., FIGS. 1-3.

Example 14—3-Dimensional Structure Based Protein Engineering of IPD080Aa for Various Functional Enhancements In silico modeling of the IPD080Aa can be done using Discovery Studio v3.5.0.12158, Copyright ©2005-12 Accelrys Software Inc. The "Calculate Mutation Energy" protocol is applied to selected residues using the CHARMm force field. The mutational energy is expressed as kcal/mol and indicates whether an amino acid change will stabilize, destabilize, or have a neutral effect on the model. The in-silico calculation along with manual exploration of the IPD080Aa solution structure are used to select candidate positions for mutagenesis.

The above description of various illustrated embodiments of the disclosure is not intended to be exhaustive or to limit the scope to the precise form disclosed. While specific embodiments of and examples are described herein for illustrative purposes, various equivalent modifications are possible within the scope of the disclosure, as those skilled in the relevant art will recognize. The teachings provided herein can be applied to other purposes, other than the examples described above. Numerous modifications and variations are possible in light of the above teachings and, therefore, are within the scope of the appended claims.

These and other changes may be made in light of the above detailed description. In general, in the following claims, the terms used should not be construed to limit the scope to the specific embodiments disclosed in the specification and the claims.

The entire disclosure of each document cited (including patents, patent applications, journal articles, abstracts, manuals, books or other disclosures) in the Background, Detailed Description, and Examples is herein incorporated by reference in their entireties.

Efforts have been made to ensure accuracy with respect to the numbers used (e.g. amounts, temperature, concentrations, etc.) but some experimental errors and deviations should be allowed for. Unless otherwise indicated, parts are parts by weight, molecular weight is average molecular weight; temperature is in degrees centigrade; and pressure is at or near atmospheric.

SEQUENCE LISTING (368 sequences)

SEQ ID NO: 1 - DNA, 891 bp, Huperzia phlegmaria
atgtctattcaaatcgacatcgagcctggcaacgtgcgggtgagtggaagttctcggcatatcattaccgatgccgatgtgagaactttcggcctcaatgacaacgccctcaagaatgctgtgctagcacacttaggcaggaggcccaatgacgccttcctcagaagccccacaccttggggtgatctctatagcacttacggttggccccaggtccagacagtgcttgcggttcggagctcccaaattcttgaggagacctccagaccggtgatgcttgcttatcagaatttcgtcaacaataccaacacggaagcaacttatacagctagcatgtctcgtgcggtgacaaattcgtcgtctaacacctggtccaatacgcactccttgacatttgaacaaaagatcaaatacggaatcaactttgggattaccgctgaaggagaaactacattgagctatgagttttcgtttggtcaaagcgggacagagtctgtcagtaccactttgagtacaggggcaggagttagtgtggttgttgccccgcatcgaaccaagcacgcaatccttagcgcctccgaagggcggatgagagtccggatccgctatgaggcatatttgacggggtctaccgccgtgaattacaatccccggcacaatggacatcatttctggggcttggggatcgctggagtgatgaggagcggcaacatcagcaacacgagaactatcactgaggacatctcgttgcagtcctattccaacggcagcgtcgtgcttggggagggaccagcgccaatttcattggtagaagcagtagaaacgttgaacgagaaggcgactgcgccaattccagaaccattggaggaggaggaagaagagaagaaggaa

SEQ ID NO: 2 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccagttacggttggcctcaggtccagacagtgcttgcagttcggagctcccaaattcttgaggagacctccagaccggtgatgcttgcttatcagactttcgtcaacaacaccaacacggaagcaacttatacagctaacatgtctcgtgtgatgagaaattcgtcgtctaacgcctggtccaatacacactccttatcgtttcaacaaaagatcaaatacggaatcaacttcgggattaccgctcaaggagaaactacattgagctataagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcctgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 3 - DNA, 906 bp, Phlegmariurus nummularifolius
atggcttttgtaatcgacatcgagcctggcaacgtgcgggtgagtggaagttctcggcatattattaccgatgccgatgtgagaacttttggcctcaatgacaacgccctaaagaatgccgtgcaagcacacttcgaaagaaggcccaatgacgccttcctcagaagccccacgccttggggtgatctctataccagttacggttggcctcaggtccagacagtgcttgcagttcggagctcccaaattcttgaggagacctccagaccggtgatgcttgcttatcagaatttcgtcaacaataccaacacggaagcaacttatacagctgacatgtctcgtgcgatgacaaattcgtcgtctaacacctggtccaatacacactccttatcatttcaacaaaagatcacatacggaatcaacttcgggattacggctgaaggagaaactacattgagctatcagttttcgtttggtcaaagtgggacagagtcggtgagcaccacgatcagtacaggggcaggagtgagtgtggtagttgccccgcaccgaaccaagcacgcaatccttatcgcttcggaagggcggatgagagtccggatccgctatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcctgcttgaggagggaccagcgccaatttcattggtagaagaagtaacaacgttgaacgagaaggcgacggcgccaattccagtgatagaatcaacagaaccattggaggaggaggaagaagagaagaaggaa

SEQ ID NO: 4 - DNA, 906 bp, Phlegmariurus nummularifolius
atggcttttgtaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccagttacggttggcctcaggtccagacagtgcttgcagttcggagctcccaaattcttgaggagacctccagaccggtgatgcttgcttatcagactttcgtcaacaacaccaacacggaagcaacttatacagctaacatgtctcgtgtgatgagaaattcgtcgtctaacgcctggtccaatacacactccttatcgtttcaacaaaagatcaaatacggaatcaacttcgggattaccgctcaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcgtgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 5 - DNA, 906 bp, Phlegmariurus nummularifolius
atgtctattcaaatcgacatcgagcctggtagcgtgcgggtgagcggaagttctcggcatatcattactgatggcgacgtgagaactttcggcctcaatgacaacgccctaaagaatgcggtgctagcacacttcgagagaaggcccaatgacgctttcctcagaagccccacgccttggggtgatctctataccacttacggttggccgcaggtccagacagtgcttgcggttcggagctcccaaattcttgaggagacctccagaccagtgatgcttgcttatcagaatttcgtcaacaataccaacacggaagcaacttatacagctaacatgtcgcgtgaggtgacaaattcgtcgtctaacacctggtccaatacacactccttgacattcgaacagaagatcaaatacggaatcaacttcgggattacggctgaaggagaaactacattgagctatgagttttcgtttggtcagagtgggacagagtcggtgagcaccacgatcagtacaggggcaggagtgagtgtggtagttggcccgcaccgaaccaagcacgcaatccttagcgcttcggaagggcggatgagagtccggatccgttatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaaccattggaggaggaggaagaagagaagaaggaa

SEQ ID NO: 6 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttgacattcgaacagaagatcaaatacggaatcaacttcgggattacggctgaaggagaaactacattgagctatgagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgttatgaagcatatctgacggggtctaccgccgtaaattacaatccccggcacagaggacatcacttctggggtttggggatcgctggagtgatgaggagcggcaacatcagcaacacgagaactatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaacctttggaggaggaggaagaagagaagaaggaa

SEQ ID NO: 7 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcaaatacggaatcaacttcgggattacggctgaaggagaaactacattgagctatgagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggcagcatcgtgcttggggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 8 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcaaatacggaatcaacttcgggattaccgctgaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggcagcatcgttcttggggagggaccagcgccaatttcattggtagaagaagtaaaaacgttgaacgagaaggcgacggcgccaattccagtgatagaatcaacagaaccattggaggaggaggaagaagagaagaaggaa

SEQ ID NO: 9 - DNA, 906 bp, Phlegmariurus nummularifolius
atgtctattcaaatcgacatcgagcctggcaacgtgcgggtgagtggaagttctcggcatatcattaccgatgccgatgtgagaactttcggcctcaatgacaacgccctcaagaatgctgtgctagcacacttgggcagaaggcccaatgacgccttcctcagaagccccacgccttggggtgatctctatacctcttacggttggccgcaggtccagacagtgcttgcggttcggagctcccaaattcttgaggagacctccagaccggtgatgcttgcttatcagaatttcgtcaacaataccaacacggaagcagagtatacagctaacatgtctcgtgagatgacaaattcgtcgtctaacacctggtccaatacgcactccttgacatttgaacaaaagatcaaatacggaatcaactttgggattactgctgaaggagaaactacactgagctatgagttttcgtttggtcaaagcgggacagagtctgtcagtaccactttgagtacaggggcaggagtgagtgtgatggttggccctcatcgaaccaagcacgtcatccttagcgcctccgaagggcggatgagagtccggatccgctatgaggcatatatgacggggtctaccgccgtgaattacaatccccggcacaacggacatcatttctggggtttgggaatcgctggagtgatgaggagcggcaacatcagcaacacgagaactatcactgaggacatctcattgcagtcctattccaacagcagcgttgtgcttggggagggaccagcgccaatttcattggtagaagcagtagaaacattgaacgagaaggcgacggcgccacctccagtggtagaatcaataccaatggaggaggaggaggaagaagagaagaaggaa

SEQ ID NO: 10 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaacatcaaatacggaatcaacttcgggattaccgctgaaggagaaactacattgagctatcagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcaccgaggacatctcattgcagtcctattccaacggcagcgtcgttcttggggagggaccagcgccaatttcattggtagaagaagtaacaacgttgaacgagaaggcgacggcgccaattccagtgatagaatcaacagaaccattggaggaggaggaagaagagaagaaggaa

SEQ ID NO: 11 - DNA, 906 bp, Phlegmariurus nummularifolius
atgtctattcaaatcgacatcgagcctggcaacgtgcgggtgagtggaagttctcagcatattattaccgatgccgatgtgagaacttttggcctcaatgacaacgccctaaagaatgccgtgcaagcacacttcgaaagaaggcccaatgacgcctttctcagaagccccacgccttggggtgatctctataccacttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcaaatacggaatcaacttcgggattaccgctgaaggagaaactacattgagctatcagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcaccgaggacatctcattgcagtcctattccaacggcagcgtcgttcttggggagggaccagcgccaatttcattggtagaagaagtaacaacgttgaacgagaaggcgacggcgccaattccagtgatagaatcaacagaaccattggaggaggaggaagaagagaagaaggaa

SEQ ID NO: 12 - DNA, 906 bp, Phlegmariurus nummularifolius
atgtctattcaaatcgacatcgagcctggcaacgtgcgggtgagtggaagttctcagcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcaaatacggaatcaacttcgggattaccgctgaaggagaaactacattgagctatcagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcaccgaggacatctcattgcagtcctattccaacggcagcgtcgttcttggggagggaccagcgccaatttcattggtagaagaagtaacaacgttgaacgagaaggcgacggcgccaattccagtgatagaatcaacagaaccattggaggaggaggaagaagagaagaaggaa

SEQ ID NO: 13 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcaaatacggaatcaacttcgggattaccgctcaaggagaaactacattgagctataagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcgtgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 14 - DNA, 906 bp, Phlegmariurus nummularifolius
atgtctattcaaatcgacatcgagcctggcaacgtgcgggtgagtggaagttctcggcatattattaccgatgccgatgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcggttcggagctcccaaattcttgaggagacctccagaccggtgatgcttgattatcggaatttcgtcaacaacaccaacacggaagcaacttatacagctaacatgtcgcgtgaggtgacaaattcgtcgtctaacacctggtccaatacacactccttgacatttgaacaaaagatcaaatacggaatcaactttgggattactgctgaaggagaaactacactgagctatgagttttcgtttggtcaaagcgggacagagtctgtcagtaccactttgagtacaggggcaggagtgagtgtgatggttggccctcatcgaaccaagcacgtcatccttagcgcctccgaagggcggatgagagtccggatccgctatgaggcatatatgacggggtctaccgccgtgaattacaatccccggcacaacggacatcatttctggggtttgggaatcgctggagtgatgaggagcggcaacatcagcaacacgagaactatcactgaggacatctcattgcagtcctattccaacagcagcgttgtgcttggggagggaccagcgccaatttcattggtagaagcagtagaaacattgaacgagaaggcgacggcgccacctccagtggtagaatcaataccaatggaggaggaggaggaagaagagaagaaggaa

SEQ ID NO: 15 - DNA, 906 bp, Phlegmariurus nummularifolius
atgtctattcaaatcgacatcgagcctggcaacgtgcgggtgagtggaagttctcggcatattattaccgatgccgatgtgagaacttttggcctcaatgacaacgccctaaagaatgccgtgcaagcacacttcgaaagaaggcccaatgacgccttcctcagaagccccacgccttggggtgatctctataccagttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcaaatacggaatcaacttcgggattaccgctcaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatacctgacggggtctaccgccgtaaattacaatcccaggcacagaggacatcacttctggggtttggggatcgctggagtgatgaggagcggcaacatcagcaacaccagaactatcactgaggacatctcattgcagtcctattccaacggcagcgtcgtgcttggggagggaccagcgccaatttcattggtagaagaagtaacaacgttgaacgagaaggcgacggcgccaattccagtgatagaatcaacagaaccattggaggaggaggaagaagagaagaaggaa

SEQ ID NO: 16 - DNA, 906 bp, Phlegmariurus nummularifolius
atggcttttgtaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcaaatacggaatcaacttcgggattaccgctgaaggagaaactacattgagctatcagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcaccgaggacatctcattgcagtcctattccaacggcagcgtcgttcttggggagggaccagcgccaatttcattggtagaagaagtaacaacgttgaacgagaaggcgacggcgccaattccagtgatagaatcaacagaaccattggaggaggaggaagaagagaagaaggaa

SEQ ID NO: 17 - DNA, 903 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggccgcaggtccagacagtgcttgcggttcggagctcccaaattcttgaggagacctccagaccagtgatgcttgcttatcagaatttcgtcaacaataccaacacggaagcaacttatacagctaacatgtcgcgtgaggtgacaaattcgtcgtctaacacctggtccaatacacactccttgacattcgaacagaagatcaaatacggaatcaacttcgggattaccgctgaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcctgcttgaggagggaccagcgccaatttcattggtagaagaagtaacaacgttgaacgagaaggcgacggcgccaattccagtgatagagtcaacagaaccattggaggaggaggaagaagagaaggac

SEQ ID NO: 18 - DNA, 906 bp, Phlegmariurus nummularifolius
atgtctattcaaatcgacatcgagcctggcaacgtgcgggtgagtggaagttctcggcatatcattaccgatgccgatgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcggttcggagctcccaaattcttgaggagacctccagaccggtgatgcttgattatcagaatttcgtcaacaacaccaacacggaagcaacttatacagctaacatgtctcgtgcggtgacaaattcgtcatctaacacctggtccaatacacactccttagcatttgaacaaaagatcaaatacggaatcaacttcgggattaccgctcaaggagaaactacattgagctatgagttttcatttggtcaaagcgggacaaagtcggtgagcaccacgatcagtacaggggcaggagtgagtgtggtagttggcccgcaccgaaccaagcacgcaatccttagcgcttcggaagggcggatgagagtccggatccgctatgaagcatatctgacggggtctaccgccgtgaattacaatcccccgcacagaggacatcacttctggggtttgggaatcgctggagtgatgaggagcggcaacatcagcaacacgagaactatcactgaggacatctcattgctgtcctattccaacggcagcgtcgtgcttggggagggaccagcgccactttcattggtagaagaagtaaaaacgttgaacgagaaggcgacggcgccaattccagtgatagaatcaacagaaccattggaggaggaggaagaagagaagaaggaa

SEQ ID NO: 19 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcaaatacggaatcaacttcgggattaccgctgaaggagaaactacattgagctatcagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcctgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 20 - DNA, 906 bp, Phlegmariurus nummularifolius
atggcttttgtaatcgacatcgagcctggtagcgtgcgggtgagcggaagttctcggcatatcattactgatggcgacgtgagaactttcggcctcaatgacaacgccctaaagaatgcggtgctagcacacttcgagagaaggcccaatgacgctttcctcagaagccccacgccttggggtgatctctataccacttacggttggccgcaggtccagacagtgcttgcggttcggagctcccaaattcttgaggagacctccagaccagtgatgcttgcttatcagaatttcgtcaacaataccaacacggaagcaacttatacagctaacatgtcgcgtgaggtgacaaattcgtcgtctaacacctggtccaatacacactccttgacattcgaacagaagatcaaatacggaatcaacttcgggattacggctgaaggagaaactacattgagctatgagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgttatgaagcatatctgacggggtctaccgccgtaaattacaatccccggcacagaggacatcacttctggggtttggggatcgctggagtgatgaggagcggcaacatcagcaacacgagaactatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaaccattggaggaggaggaagaagagaagaaggaa

SEQ ID NO: 21 - DNA, 903 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccagttacggttggcctcaggtccagacagtgcttgcagttcggagctcccaaattcttgaggagacctccagaccggtgatgcttgattatcagaatttcgtcaacaacaccaacacggaagcaacttatccagctaacatgtctcgtgcggtgacaacttcgttgtctaacacctggtccaatacacactccttagcatttgaacaaaagatcaaatacggaatcaacttcgggattaccgctgaaggagaaactacattgagctatcagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcaccgaggacatctcattgcagtcctattccaacggcagcgtcgttcttggggagggaccagcgccaatttcattggtagaagaagtaacaacgttgaacgagaaggcgacggcgccaattccagtgatagaatcaacagaaccattggaggaggaggaagaagagaaggac

SEQ ID NO: 22 - DNA, 905 bp, Phlegmariurus nummularifolius
atgtctattcaaatcgacatcgagcctggcaacgtgcgggtgagtggaagttctcggcatattattaccgatgccgatgtgagaacttttggcctcaatgacaacgccctaaagaatgccgtgcaagcacacttcgaaagaaggcccaatgacgccttcctcagaagccccacgccttggggtgatctctataccagttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcgtttcaacaaaagatcaaatacggaatcaacttcgggattaccgctcaaggagaaactacattgagctataagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcctgcttgaggagggaccagcgccaatttcattggtagaagaagtaacaacgttgaacgagaaggcgacggcgccaattccagtgatagagtcaacagaaccattggaggaggaggaagaagagaagaggaa

SEQ ID NO: 23 - DNA, 903 bp, Phlegmariurus nummularifolius
atgtctattcaaatcgagatcgagcctggcaacgtgcgggtgagtggaagttctcggcatattattaccgatgccgatgtgagaacttttggcctcaatgacaacgccctaaagaatgccgtgcaagcacacttcgaaagaaggcccaatgacgccttcctcagaagccccacgccttggggtgatctctataccagttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcacatacggaatcaacttcgggattacggctgaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaaccattggaggaggaggaagaagagaaggac

SEQ ID NO: 24 - DNA, 906 bp, Phlegmariurus nummularifolius
atggcttttctaatcgacatcgagcctggcaacgtgcgggtgagtggaagttctcagcatattattaccgatgccgatgtgagaacttttggcctcaatgacaacgccctaaagaatgccgtgcaagcacacttcgaaagaaggcccaatgacgcctttctcagaagccccacgccttggggtgatctctataccacttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcagtgacaaattcgtcgtctaacacctggtccaatacacactccttagcatttgaacaaaagatcaaatacggaatcaacttcgggattaccgctcaaggagaaactacattgagctatgagttttcgtttggtcaaagcgggacagagtcggtgagcaccacgatcagtacaggggcaggagtgagtgtggtagttggcccgcaccgaaccaagcacgcaatccttagcgcttcggaagggcggatgagagtccggatccgctatgaagcatatctgacggggtctaccgccgtaaattacaatccccggcacagaggacatcacttctggggtttgggaatcactggagtgatgaggagcggcaacatcagcaacacgagaactatcactgaggacatctcattgctgtcctattccaacggcagcgtcgtgcttggggagggaccagcgccactttcattggtagaagaagtaaaaacgttgaacgagaaggcgacggcgccaattccagtgatagaatcaacagaaccattggaggaggaggaagaagagaagaaggaa

SEQ ID NO: 25 - DNA, 903 bp, Phlegmariurus nummularifolius
atgtctattcaaatcgacatcgagcctggcaacgtgcgggtgagtggaagttctcggcatattattaccgatgccgatgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcggttcggagctcccaaattcttgaggagacctccagaccggtgatgcttgattatcggaatttcgtcaacaacaccaacacggaagcaacttatacagctaacatgtctcgttcggtgacaaattcgtcgtctaacacctggtccaatacacactccttagcatttgaacaaaagatcaaatacggaatcaacttcgggattaccgctcaaggagaaactacattgagctatgagttttcgtttggtcaaagcgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttgggaatcgctggagtgatgaggagcggcaacatcagcaacacgagaactatcactgaggacatctcattgctgtcctattccaacggcagcgtcgtgcttggggagggaccagcgccactttcattggtagaagaagtaaagacgttgaacgagaaggcgacggcgccaattccagtgatagaatcaacagaattattggaggaggaagaagagaagaaggaa

SEQ ID NO: 26 - DNA, 903 bp, Phlegmariurus nummularifolius
atgtctattcaaatcgacatcgagcctggcaacgtgcgggtgagtggaagttctcggcatattattaccgatgccgatgtgagaacttttggcctcaatgacaacgccctaaagaatgccgtgcaagcacacttcgaaagaaggcccaatgacgccttcctcagaagccccacgccttggggtgatctctataccagttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcacatacggaatcaacttcgggattacggctgaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaaccattggaggaggaggaagaagagaaggac

SEQ ID NO: 27 - DNA, 906 bp, Phlegmariurus nummularifolius
atgtctattcaaatcgacatcgagcctggcaacgtgcgggtgagtggaagttctcagcatattattaccgatgccgatgtgagaacttttggcctcaatgacaacgccctaaagaatgccgtgcaagcacacttcgaaagaaggcccaatgacgcctttctcagaagccccacgccttggggtgatctctataccagttacggttggcctcaggtccagacagtgcttgcagttcggagctcccaaattcttgaggagacctccagaccggtgatgcttgattatcagaatttcgtcaacaacaccaacacggaagcaacttatacagctaacatgtctcgtgcggtgacaaattcgtcatctaacacctggtccaatacacactccttagcatttgaacaaaagatcaaatacggaatcaacttcgggattaccgctcaaggagaaactacattgagctatgagttttcatttggtcaaagcgggacaaagtcggtgagcaccacgatcagtacaggggcaggagtgagtgtggtagttggcccgcaccgaaccaagcacgcaatccttagcgcttcggaagggcggatgagagtccggatccgctatgaagcatatctgacggggtctaccgccgtgaattacaatcccccgcacagaggacatcacttctggggtttgggaatcgctggagtgatgaggagcggcaacatcagcaacacgagaactatcactgaggacatctcattgctgtcctattccaacggcagcgtcgtgcttggggagggaccagcgccactttcattggtagaagaagtaaaaacgttgaacgagaaggcgacggcgccaattccagtgatagaatcaacagaaccattggaggaggaggaagaagagaagaaggaa

SEQ ID NO: 28 - DNA, 906 bp, Phlegmariurus nummularifolius
atgtctattcaaatcgacatcgagcctggcaacgtgcgggtgagtggaagttctcggcatattattaccgatgccgatgtgagaacttttggcctcaatgacaacgccctaaagaatgccgtgcaagcacacttcgaaagaaggcccaatgacgcctttctcagaagccccacgccttggggtgatctctataccagttacggttggcctcaggtccagacagtgcttgcagttcggagctcccaaattcttgaggagacctccagaccggtgatgcttgcttatcagactttcgtcaacaacaccaacacggaagcaacttatacagctaacatgtctcgtgtgatgagaaattcgtcgtctaacgcctggtccaatacacactccttatcgtttcaacaaaagatcaaatacggaatcaacttcgggattaccgctcaaggagaaactacattgagctataagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcaccgaggacatctcattgcagtcctattccaacggcagcgtcgttcttggggagggaccagcgccaatttcattggtagaagaagtaacaacgttgaacgagaaggcgacggcgccaattccagtgatagaatcaacagaaccattggaggaggaggaagaagagaagaaggaa

SEQ ID NO: 29 - DNA, 903 bp, Phlegmariurus nummularifolius
atgtctattcaaatcgacatcgagcctggcaacgtgcgggtgagtggaagttctcagcatattattaccgatgccgatgtgagaacttttggcctcaatgacaacgccctaaagaatgccgtgcaagcacacttcgaaagaaggcccaatgacgccttcctcagaagccccacgccttggggtgatctctataccagttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcacatacggaatcaacttcgggattacggctgaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaaccattggaggaggaggaagaagagaaggac

SEQ ID NO: 30 - DNA, 903 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgattatcagaatttcgtcaacaacaccaacacggaagcaacttatccagctaacatgtctcgtgcggtgacaacttcgttgtctaacacctggtccaatacacactccttagcatttgaacaaaagatcaaatacggaatcaacttcgggattaccgctgaaggagaaactacattgagctatcagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcaccgaggacatctcattgcagtcctattccaacggcagcgtcgttcttggggagggaccagcgccaatttcattggtagaagaagtaacaacgttgaacgagaaggcgacggcgccaattccagtgatagaatcaacagaaccattggaggaggaggaagaagagaaggac

SEQ ID NO: 31 - DNA, 903 bp, Phlegmariurus nummularifolius
atgtctattcaaatcgacatcgagcctggcaacgtgcgggtgagtggaagttctcagcgtattattaccgatgccgatgtgagaacttttggcctcaatgacaacgccctaaagaatgccgtgcaagcacacttcgaaagaaggcccaatgacgccttcctcagaagccccacgccttggggtgatctctataccagttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcacatacggaatcaacttcgggattacggctgaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaaccattggaggaggaggaagaagagaaggac

SEQ ID NO: 32 - DNA, 903 bp, Phlegmariurus nummularifolius
atgtctattcaaatcgacatcgagcctggcaacgtgcgggtgagtggaagttctcggcatatcattaccgatgccgatgtgagaacttttggcctcaatgacaacgccctaaagaatgcggtgctagcacacttcgagagaaggcccaatgacgctttcctcagaagccccacgccttggggtgatctctataccacttacggttggccgcaggtccagacagtgcttgcggttcggagctcccaaattcttgaggagacctccagaccagtgatgcttgcttatcagaatttcgtcaacaataccaacacggaagcaacttatacagctaacatgtcgcgtgaggtgacaaattcgtcgtctaacacctggtccaatacacactccttagcatttcaacaaaagatcaaatacggaatcaacttcgggattaccgctgaaggagaaactacattgagctatcagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttgggaatcgctggagtgatgaggagcggcaacatcagcaacacgagaactatcactgaggacatctcattgctgtcctattccaacggcagcgtcgtgcttggggagggaccagcgccactttcattggtagaagaagtaaaaacgtttaacgagaaggcgacggcgccaattccagtgatagaatcaacagaattattggaggaggaagaagagaagaaggaa

SEQ ID NO: 33 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgcaagcacacttcgaaagaaggcccaatgacgccttcctcagaagccccacgccttggggtgatctctataccagttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcacatacggaatcaacttcgggattacggctgaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcctgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 34 - DNA, 906 bp, Phlegmariurus nummularifolius
atgtctattcaaatcgacatcgagcctggtagcgtgcgggtgagcggaagttctcggcatatcattactgatggcgacgtgagaactttcggcctcaatgacaacgccctaaagaatgcggtgctagcacacttcgagagaaggcccaatgacgctttcctcagaagccccacgccttggggtgatctctataccacttacggttggccgcaggtccagacagtgcttgcggttcggagctcccaaattcttgaggagacctccagaccggtgatgcttgcttatcagaatttcgtcaacaataccaacacggaagcagagtatacagctaacatgtctcgtgagatgacaaattcgtcgtctaacacctggtccaatacgcactccttgacatttgaacaaaagatcaaatacggaatcaactttgggattactgctgaaggagaaactacactgagctatgagttttcgtttggtcaaagcgggacagagtctgtcagtaccactttgagtacaggggcaggagtgagtgtgatggttggccctcatcgaaccaagcacgtcatccttagcgcctccgaagggcggatgagagtccggatccgctatgaggcatatatgacggggtctaccgccgtgaattacaatccccggcacaacggacatcatttctggggtttgggaatcgctggagtgatgaggagcggcaacatcagcaacacgagaactatcactgaggacatctcattgcagtcctattccaacggccgcgtcctgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 35 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagactttcgtcaacaacaccaacacggaagcaacttatacagctaacatgtctcgtgtgatgagaaattcgtcgtctaacgcctggtccaatacacactccttatcgtttcaacaaaagatcaaatacggaatcaacttcgggattaccgctcaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcgtgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 36 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccagttacggttggcctcaggtccagacagtgcttgcagttcggagctcccaaattcttgaggagacctccagaccggtgatgcttgcttatcagactttcgtcaacaacaccaacacggaagcaacttatacagctaacatgtctcgtgtgatgagaaattcgtcgtctaacgcctggtccaatacacactccttatcgtttcaacaaaagatcaaatacggaatcaacttcgggattaccgctcaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcgtgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 37 - DNA, 903 bp, Phlegmariurus nummularifolius
atgtctattcaaatcgacatcgagcctggcaacgtgcgggtgagtggaagttctcggcatattattaccgatgccgatgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcggttcggagctcccaaattcttgaggagacctccagaccggtgatgcttgattatcggaatttcgtcaacaacaccaacacggaagcaacttatacagctaacatgtctccttcggtgacaaattcgtcgtctaacacctggtccaatacacactccttagcatttgaacaaaagatcaaatacggaatcaacttcgggattaccgctcaaggagaaactacattgagctatgagttttcgtttggtcaaagcgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttgggaatcgctggagtgatgaggagcggcaacatcagcaacacgagaactatcactgaggacatctcattgctgtcctattccaacggcagcgtcgtgcttggggagggaccagcgccactttcattggtagaagaagtaaagacgttgaacgagaaggcgacggcgccaattccagtgatagaatcaacagaattattggaggaggaagaagagaagaaggaa

SEQ ID NO: 38 - DNA, 906 bp, Phlegmariurus nummularifolius
atgtctattcaaatcgacatcgagcctggcaacgtgcgggtgagtggaagttctcagcatattattaccgatgccgatgtgagaacttttggcctcaatgacaacgccctaaagaatgccgtgcaagcacacttcgaaagaaggcccaatgacgcctttctcagaagccccacgccttggggtgatctctataccagttacggttggcctcaggtccagacagtgcttgcagttcggagctcccaaattcttgaggagacctccagaccggtgatgcttgcttatcagactttcgtcaacaacaccaacacggaagcaacttatacagctaacatgtctcgtgtgatgagaaattcgtcgtctaacgcctggtccaatacacactccttatcgtttcaacaaaagatcaaatacggaatcaacttcgggattaccgctcaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggcagcgtcgttcttggggagggaccagcgccaatttcattggtagaagaagtaacaactttgaacgagaaggcgacggcgccaattccagtgatagagtcaacagaaccattggaggaggaggaagaagagaagaaggaa

SEQ ID NO: 39 - DNA, 906 bp, Phlegmariurus nummularifolius
atggcttttgtaatcgacatcgagcctggtagcgtgcgggtgagcggaagttctcggcatattattaccgatgccgacgtgagaactttcggcctcaatgacaacgccctaaagaatgccgtgcaagcacacttcgaaagaaggcccaatgacgcctttctcagaagccccacgccttggggtgatctctataccagttacggttggcctcaggtccagacagtgcttgcagttcggagctcccaaattcttgaggagacctccagaccggtgatgcttgcttatcagaatttcgtcaacaataccaacacggaagcaacttatacagctgacatgtctcgtgcgatgacaaattcgtcgtctaacacctggtccaatacacactccttatcatttcaacaaaagatcacatacggaatcaacttcgggattacggctgaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaaccattggaggaggaggaagaagagaagaaggaa

SEQ ID NO: 40 - DNA, 905 bp, Phlegmariurus nummularifolius
atggcttttctaatcgacatcgagcctggtagcgtgcgggtgagcggaagttctcggcatattattaccgatgccgacgtgagaactttcggcctcaatgacaacgccctaaagaatgccgtgcaagcacacttcgaaagaaggcccaatgacgcctttctcagaagccccacgccttggggtgatctctataccagttacggttggcctcaggtccagacagtgcttgcagttcggagctcccaaattcttgaggagacctccagaccggtgatgcttgcttatcagaatttcgtcaacaataccaacacggaagcaacttatacagctgacatgtctcgtgcgatgacaaattcgtcgtctaacacctggtccaatacacactccttatcatttcaacaaaagatcacatacggaatcaacttcgggattacggctgaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaaccattggaggaggaggagaagagaagaaggaa

SEQ ID NO: 41 - DNA, 906 bp, Phlegmariurus nummularifolius
atgtctattcaaatcgacatcgagcctggcaacgtgcgggtgagtggaagttctcagcatattattaccgatgccgatgtgagaacttttggcctcaatgacaacgccctaaagaatgccgtgcaagcacacttcgaaagaaggcccaatgacgcctttctcagaagccccacgccttggggtgatctctataccagttacggttggcctcaggtccagacagtgcttgcagttcggagctcccaaattcttgaggagacctccagaccggtgatgcttgcttatcagactttcgtcaacaacaccaacacggaagcaacttatacagctaacatgtctcgtgtgatgagaaattcgtcgtctaacgcctggtccaatacacactccttatcgtttcaacaaaagatcaaatacggaatcaacttcgggattaccgctcaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcctgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 42 - DNA, 903 bp, Phlegmariurus nummularifolius
atgtctattcaaatcgacatcgagcctggcaacgtgcgggtgagtggaagttctcggcatattattaccgatgccgatgtgagaacttttggcctcaatgacaacgccctaaagaatgccgtgcaagcacacttcgaaagaaggcccaatgacgccttcctcagaagccccacgccttggggtgatctctataccagttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgtgatgagaaattcgtcgtctaacgcctggtccaatacacactccttatcgtttcaacaaaagatcaaatacggaatcaacttcgggattaccgctcaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatacctgacggggtctaccgccgtaaattacaatccccggcacagaggacatcacttctggggtttgggaatcgctggagtgatgaggagcggcaacatcagcaacacgagaactatcactgaggacatctcattgctgtcctattccaacggcagcgtcgtgcttggggagggaccagcgccactttcattggtagaagaagtaaagacgttgaacgagaaggcgacggcgccaattccagtgatagaatcaacagaattattggaggaggaagaagagaagaaggaa

SEQ ID NO: 43 - DNA, 906 bp, Phlegmariurus nummularifolius
atggcttttgtaatcgacatcgagcctggcaacgtgcgggtgagtggaagttctcggcatattattaccgatgccgatgtgagaacttttggcctcaatgacaacgccctaaagaatgccgtgcaagcacacttcgaaagaaggcccaatgacgccttcctcagaagccccacgccttggggtgatctctataccagttacggttggcctcaggtccagacagtgcttgcagttcggagctcccaaattcttgaggagacctccagaccggtgatgcttgcttatcagactttcgtcaacaacaccaacacggaagcaacttatacagctaacatgtctcgtgtgatgagaaattcgtcgtctaacgcctggtccaatacacactccttatcgtttcaacaaaagatcaaatacggaatcaacttcgggattaccgctcaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaaccattggaggaggaggaagaagagaagaaggaa

SEQ ID NO: 44 - DNA, 906 bp, Phlegmariurus nummularifolius
atgtctattcaaatcgacatcgagcctggcaacgtgcgggtgagtggaagttctcagcatattattaccgatgccgatgtgagaacttttggcctcaatgacaacgccctaaagaatgccttgcaagcacacttcgaaagaaggcccaatgacgcctttctcagaagccccacgccttggggtgatctctataccagttacggttggcctcaggtccagacagtgcttgcagttcggagctcccaaattcttgaggagacctccagaccggtgatgcttgcttatcagactttcgtcaacaacaccaacacggaagcaacttatacagctaacatgtctcgtgtgatgagaaattcgtcgtctaacgcctggtccaatacacactccttatcgtttcaacaaaagatcaaatacggaatcaacttcgggattaccgctcaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcctgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 45 - DNA, 906 bp, Phlegmariurus nummularifolius
atggcttttgtaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccagttacggttggcctcaggtccagacagtgcttgcagttcggagctcccaaattcttgaggagacctccagaccggtgatgcttgcttatcagactttcgtcaacaacaccaacacggaagcaacttatacagctaacatgtctcgtgtgatgagaaattcgtcgtctaacgcctggtccaatacacactccttatcgtttcaacaaaagatcaaatacggaatcaacttcgggattaccgctcaaggagaaactacattgagctatcagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcaccgaggacatctcattgcagtcctattccaacggcagcgtcgttcttggggagggaccagcgccaatttcattggtagaagaagtaacaacgttgaacgagaaggcgacggcgccaattccagtgatagaatcaacagaaccattggaggaggaggaagaagagaagaaggaa

SEQ ID NO: 46 - DNA, 903 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcaaatacggaatcaacttcgggattaccgctgaaggagaaactacattgagctatcagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcaccgaggacatctcattgcagtcctattccaacggcagcgtcgttcttggggagggaccagcgccaatttcattggtagaagaagtaacaacgttgaacgagaaggcgacggcgccaattccagtgatagaatcaacagaaccattggaggaggaggaagaagagaaggac

SEQ ID NO: 47 - DNA, 908 bp, Phlegmariurus nummularifolius
atgtctattcaaatcgacatcgagcctggcaacgtgcgggtgggtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcaaatacggaatcaacttcgggattaccgctgaaggagaaactacattgagctatcagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcaccgaggacatctcattgcagtcctattccaacggcagcgtcgttcttggggagggaccagcgccaatttcattggtagaagaagtaacaacgttgaacgagaaggcgacggcgccaattccagtgatagaatcaacagaaccattggaggaggaggaagaagagaaggacggatc

SEQ ID NO: 48 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcaaatacggaatcaacttcgggattaccgctgaaggagaaactacattgagctatcagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacacgagaactatcactgaggacatctcattgctgtcctattccaacggcagcgtcgtgcttggggagggaccagcgccactttcattggtagaagaagtaaaaacgttgaacgagaaggcgacggcgccaattccagtgatagaatcaacagaaccattggaggaggaggaagaagagcagaaggaa

SEQ ID NO: 49 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcaaatacggaatcaacttcgggattaccgctgaaggagaaactacattgagctatcagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcaccgaggacatctcattgcagtcctattccaacggcagcgtcgttcttggggagggaccagcgccaatttcattggtagaagaagtaacaacgttgaacgagaaggcgacggcaccaattccagtgatagaatcaacagaaccattggaggaggaggaagaagagaagaaggaa

SEQ ID NO: 50 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcaaatacggaatcaacttcgggattaccgctgaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcccgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 51 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcaaatacggaatcaacttcgggattaccgctgaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcctgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 52 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaacaccaacacggaagcaacttatacagctaacatctctcgtgcgatgacaaattcgtcgtctaacacctggtccaatacacactccttatcatttcaacaaaagatcaaatacggaatcaacttcgggattaccgctgaaggagaaactacattgagctatcagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcaccgaggacatctcattgcagtcctattccaacggcagcgtcgttcttggggagggaccagcgccaatttcattggtagaagaagtaacaacgttgaacgagaaggcgacggcgccaattccagtgatagaatcaacagaaccattggaggaggaggaagaagagaagaaggaa

SEQ ID NO: 53 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaataccaacacggaagcaacttatacagctgacatgtctcgtgcgatgacaaattcgtcgtctaacacctggtccaatacacactccttatcatttcaacaaaagatcacatacggaatcaacttcgggattacggctgaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaaccattggaggaggaggaagaagagaagaaggaa

SEQ ID NO: 54 - DNA, 906 bp, Phlegmariurus nummularifolius
atgtctattcaaatcgacatcgagcctggcaacgtgcgggtgagtggaagttctcagcatattattaccgatgccgatgtgagaacttttggcctcaatgacaacgccctaaagaatgccgtgcaagcacacttcgaaagaaggcccaatgacgcctttctcagaggccccacgccttggggtgatctctataccagttacggttggcctcaggtccagacagtgcttgcagttcggagctcccaaattcttgaggagacctccagaccggtgatgcttgcttatcagactttcgtcaacaacaccaacacggaagcaacttatacagctaacatgtctcgtgtgatgagaaattcgtcgtctaacgcctggtccaatacacactccttatcgtttcaacaaaagatcaaatacggaatcaacttcgggattaccgctcaaggagaaactacattgagctataagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggatcgctggagtgatgaggagcggcgacatcagcaacaccagaactatcactgaggacatctcattgcagtcctattccaacggccgcgtcctgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 55 - DNA, 906 bp, Phlegmariurus nummularifolius
atgtctattcaaatcgacatcgagcctggcaacgtgcgggtgagtggaagttctcagcatattattaccgatgccgatgtgagaacttttggcctcaatgacaacgccctaaagaatgccgtgcaagcacacttcgaaagaaggcccaatgacgcctttctcagaagccccacgccttggggtgatctctataccagttacggttggcctcaggtccagacagtgcttgcagttcggagctcccaaattcttgaggagacctccagaccggtgatgcttgcttatcagactttcgtcaacaacaccaacacggaagcaacttatacagctaacatgtctcgtgtgatgagaaattcgtcgtctaacgcctggtccaatacacactccttatcgtttcaacaaaagatcaaatacggaatcaacttcgggattaccgctcaaggagaaactacattgagctataagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcctgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 56 - DNA, 906 bp, Phlegmariurus nummularifolius
atgtctattcaaatcgacatcgagcctggtagcgtgcgggtgagcggaagttctcggcatatcattactgatggcgacgtgagaactttcggcctcaatgacaacgccctaaagaatgcggtgctagcacacttcgagagaaggcccaatgacgctttcctcagaagccccacgccttggggtgatctctataccacttacggttggccgcaggtccagacagtgcttgcggttcggagctcccaaattcttgaggagacctccagaccagtgatgcttgcttatcagactttcgtcaacaacaccaacacggaagcaacttatacagctaacatgtctcgtgtgatgagaaattcgtcgtctaacgcctggtccaatacacactccttatcgtttcaacaaaagatcaaatacggaatcaacttcggaattaccgctgaaggagaaactacattgagctatcagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcaccgaggacatctcattgcagtcctattccaacggcagcgtcgttcttggggagggaccagcgccaatttcattggtagaagaagtaacaacgttgaacgagaaggcgacggcgccaattccagtgatagaatcaacagaaccattggaggaggaggaagaagagaagaaggaa

SEQ ID NO: 57 - DNA, 906 bp, Phlegmariurus nummularifolius
atgtctattcaaatcgacatcgagcctggtagcgtgcgggtgagcggaagttctcggcatatcattactgatggcgacgtgagaactttcggcctcaatgacaacgccctaaagaatgcggtgctagcacacttcgagagaaggcccaatgacgctttcctcagaagccccacgccttggggtgatctctataccacttacggttggccgcaggtccagacagtgcttgcggttcggagctcccaaattcttgaggagacctccagaccagtgatgcttgcttatcagactttcgtcaacgacaccaacacggaagcaacttatacagctaacatgtctcgtgtgatgagaaattcgtcgtctaacgcctggtccaatacacactccttatcgtttcaacaaaagatcaaatacggaatcaacttcgggattaccgctgaaggagaaactacattgagctatcagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcaccgaggacatctcattgcagtcctattccaacggcagcgtcgttcttggggagggaccagcgccaatttcattggtagaagaagtaacaacgttgaacgagaaggcgacggcgccaattccagtgatagaatcaacagaaccattggaggaggaggaagaagagaagaaggaa

SEQ ID NO: 58 - DNA, 906 bp, Phlegmariurus nummularifolius
atgtctattcaaatcgacatcgagcctggtagcgtgcgggtgagcggaagttctcggcatatcattactgatggcgacgtgagaactttcggcctcaatgacaacgccctaaagaatgcggtgctagcacacttcgagagaaggcccaatgacgctttcctcagaagccccacgccttggggtgatctctataccacttacggttggccgcaggtccagacagtgcttgcggttcggagctcccaaattcttgaggagacctccagaccagtgatgcttgcttatcagactttcgtcaacaacaccaacacggaagcaacttatacagctaacatgtctcgtgtgatgagaaattcgtcgtctaacgcctggtccaatacacactccttatcgtttcaacaaaagatcaaatacggaatcaacttcgggattaccgctgaaggagaaactacattgagctatcagttttcgtttggtcaaagtgggacagagtcggtgagcaccacggtcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcaccgaggacatctcattgcagtcctattccaacggcagcgtcgttcttggggagggaccagcgccaatttcattggtagaagaagtaacaacgttgaacgagaaggcgacggcgccaattccagtgatagaatcaacagaaccattggaggaggaggaagaagagaagaaggaa

SEQ ID NO: 59 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcggttcggagctcccaaattcttgaggagacctccagaccggtgatgcttgcttatcagaatttcgtcaacaacaccaacacggaagcaacttatacagctaacatgtctcgtgcggtgacaaattcgtcgtctaacacctggtccaatacacactccttagcatttgaacaaaagatcaaatacggaatcaacttcgggattaccgctcaaggagaaactacattgagctatgagttttcgtttggtcaaagcgggacagagtcggtgagcaccaagatcagtacaggggcaggagtgagtgtggtagttggcccgcaccgaaccaagcacgcaatccttagcgcttcggaagggcggatgagagtccggatccgctatgaagcatatctgacggggtctaccgccgtaaattacaatccccggcacagaggacatcacttctggggtttgggaatcgctgcagtgatgaggagcggcaacatcagcaacacgagaactatcactgaggacatctcattgctgtcctattccaacggcagcgtcgtgcttggggagggaccagcgccactttcattggtagaagaagtaaaaacgttgaacgagaaggcgacggcgccaattccagtgatagaatcaacagaaccattggaggaggaggaagaagagaagaaggaa

SEQ ID NO: 60 - DNA, 906 bp, Phlegmariurus nummularifolius
atgtctattcaaatcgacatcgagcctggtagcgtgcgggtgagcggaagttctcggcatatcattactgatggcgacgtgagcactttcggcctcaatgacaacgccctaaagaatgcggtgctagcacacttcgagagaaggcccaatgacgctttcctcagaagccccacgccttggggtgatctctataccacttacggttggccgcaggtccagacagtgcttgcggttcggagctcccaaattcttgaggagacctccagaccagtgatgcttgcttatcagaatttcgtcaacaataccaacacggaagcaacttatacagctaacatgtcgcgtgaggtgacaaattcgtcgtctaacacctggtccaatacacactccttgacattcgaacagaagatcaaatacggaatcaacttcgggattacggctgaaggagaaactacattgagctatgagttttcgtttggtcagagtgggacagagtcggtgagcaccacgatcagtacaggggcaggagtgagtgtggtagttggcccgcaccgaaccaagcacgcaatccttagcgcttcggaagggcggatgagagtccggatccgttatgaagcatatctgacggggtctaccgccgtaaattacaatccccggcacagaggacatcacttctggggtttgggaatcgctggagtgatgaggagcggcaacatcagcaacacgagaactatcactgaggacatctcattgctgtcctattccaacggcagcgtcgtgcttggggagggaccagcgccactttcattggtagaagaagtaaaaacgttgaacgagaaggcgacggcgccaattccagtgatagaatcaacagaaccattggaggaggaggaagaagagaagaaggaa

SEQ ID NO: 61 - DNA, 906 bp, Phlegmariurus nummularifolius
atgtctattcaaatcgacatcgagcctggcaacgtgcgggtgagtggaagttctcggcatatcattaccgatgccgatgtgagaactttcggcctcaatgacaacgccctcaagaatgctgtgctagcacacttgggcagaaggcccaatgacgccttcctcagaagccccacgccttggggtgatctctatacctcttacggttggccgcaggtccagacagtgcttgcggttcggagctcccaaattcttgaggagacctccagaccggtgatgcttgcttatcagaatttcgtcgacaataccaacacggaagcagagtatacagctaacatgtctcgtgagatgacaaattcgtcgtctaacacctggtccaatacgcactccttgacatttgaacaaaagatcaaatacggaatcaactttgggattactgctgaaggagaaactacactgagctatgagttttcgtttggtcaaagcgggacagagtctgtcagtaccactttgagtacaggggcaggagtgagtgtgatggttggccctcatcgaaccaagcacgtcatccttagcgcctccgaagggcggatgagagtccggatccgctatgaggcatatatgacggggtctaccgccgtgaattacaatccccggcacaacggacatcatttctggggtttgggaatcgctggagtgatgaggagcggcaacatcagcaacacgagaactatcactgaggacatctcattgcagtcctattccaacagcagcgttgtgcttggggagggaccagcgccaatttcattggtagaagcagtagaaacattgaacgagaaggcgacggcgccacctccagtggtagaatcaataccaatggaggaggaggaggaagaagagaagaaggaa

SEQ ID NO: 62 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgttcggtgacaaattcgtcgtctaacacctggtccaatacacactccttagcatttgaacaaaagatcaaatacggaatcaacttcgggattaccgctcaaggagaaactacattgagctatcagttttcgtttggtcaaagtgggacagagtcggtgagcaccacgatcagtacaggggcaggagtgagtgtggtggttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcctgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 63 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatggcgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgttcggtgacaaattcgtcgtctaacacctggtccaatacacactccttagcatttgaacaaaagatcaaatacggaatcaacttcgggattaccgctcaaggagaaactacattgagctatcagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgccggagtgatgaggagcggcaacatcagcaacaccagaactatcactgaggacatctcattgcagtcctattccaacggccgcgtcctgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 64 - DNA, 906 bp, Phlegmariurus nummularifolius
atgtctattcaaatcgacatcgagcctggcaacgtgcgggtgagtggaagttctcggcatattattaccgatgccgatgtgagaacttttggcctcaatgacaacgccctaaagaatgccgtgcaagcacacttcgaaagaaggcccaatgacgcctttctcagaagccccacgccttggggtgatctctataccagttacggttggcctcaggtccagacagtgcttgcagttcggagctcccaaattcttgaagagacctccagaccggtgatgcttgcttatcagaatttcgtcaacaacaccaacacggaagcaacttatacagctaacatgtctcgtgcgatgacatattcgtcgtctaacacctggtccaatacacactccttatcatttcaacaaaagatcaaatacggaatcaacttcgggattaccgctcaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaaccattggaggaggaggaagaagagaagaaggaa

SEQ ID NO: 65 - DNA, 906 bp, Phlegmariurus nummularifolius
atgtctattcaaatcgacatcgagcctggcaacgtgcgggtgagtggaagttctcggcatattattaccgatgccgatgtgagaacttttggcctcaatgacaacgccctaaagaatgccgtgcaagcacacttcgaaagaaggcccaatgacgcctttctcagaagccccacgccttggggtgatctctataccagttacggttggcctcaggtccagacagtgcttgcagttcggagctcccaaattcttgaggagacctccagaccggtgatgcttgcttatcagaatttcgtcaacaacaccaacacggaagcaacttatacagctaacatgcctcgtgcgatgacaaattcgtcgtctaacacctggtccaatacacactccttatcatttcaacaaaagatcaaatacggaatcaacttcgggattaccgctcaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagagctatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaaccattggaggaggaggaagaagagaagaaggaa

SEQ ID NO: 66 - DNA, 906 bp, Phlegmariurus nummularifolius
atgtctattcaaatcgacatcgagcctggcaacgtgcgggtgagtggaagttctcggcatattattaccgatgccgatgtgagaacttttggcctcaatgacaacgccctaaagaatgccgtgcaagcacacttcgaaagaaggcccaatgacgcctttctcagaagccccacgccttggggtgatctctataccagttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcaaatacggaatcaacttcgggattaccgctcaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaaccattggaggaggaggaagaagagaagaagaaa

SEQ ID NO: 67 - DNA, 906 bp, Phlegmariurus nummularifolius
atgtctattctaatcgacatcaagcctggcagcgtgcgggtgagtggaagttctcggcatatcattaccgatgccgatgtgagaactttcggcctcaatgacaacgccctcaataatgctgtgctagcacacttgggcagaaggcccaatgacgccttcctcagaagccccacgccttggggtgatctctatacctcttacggttggccgcaggtccagacagtgcttgcggttcggagctcccaaattcttgaggagacctccagaccggtgatgcttgcttatcagaatttcgtcaacaataccaacacggaagcagagtatacagctaacatgtctcgtgagatgacaaattcgtcgtctaacacctggtccaatacgcactccttgacatttgaacaaaagatcaaatacggaatcaactttgggattactgctgaaggagaaactacactgagctatgagttttcgtttggtcaaagcgggacagagtctgtcagtaccactttgagtacaggggcaggagtgagtgtgatggttggccctcatcgaaccaagcacgtcatccttagcgcctccgaagggcggatgagagtccggatccgctatgaggcatatatgacggggtctaccgccgtgaattacaatccccggcacagaggacatcacttctggggtttggggatcgctggagtgatgaggagcggcaacatcagcaacaccagaactatcactgaggacatctcattgcagtcctattccaacggccgcgtcctgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 68 - DNA, 906 bp, Phlegmariurus nummularifolius
atgtctattcaaatcgacatcgagcctggcaacgtgcgggtgagtggaagttctcggcatatcattaccgatgccgatgtgagaactttcggcctcaatgacaacgccctcaagaatgctgtgctagcacacttgggcagaaggcccaatgacgccttcctcagaagccccacgccttggggtgatctctatacctcttacggttggccgcaggtccagacagtgcttgcggttcggagctcccaaattcttgaggagacctccagaccggtgatgcttgcttatcagaatttcgtcaacaataccaacacggaagcagagtatacagctaacatgtctcgtgagatgacaaattcgtcgtctaacacctggtccaatacgcactccttgacatttgaacaaaagatcaaatacggaatcaactttgggattactgctgaaggagaaactacactgagctatgagttttcgtttggtcaaagcgggacagagtctgtcagtaccactttgagtacaggggcaggagtgagtgtgatggttggccctcatcgaaccaagcacgtcatccttagcgcctccgaagggcggatgagagtccggatccgctatgaggcatatatgacggggtctaccgccgtgaattacaatccccggcacagaggacatcacttctggggtttggggatcgctggagtgatgaggagcggcaacatcagcaacaccagaactatcactgaggacatctcattgcagtcctattccaacggccgcgtcctgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 69 - DNA, 906 bp, Phlegmariurus nummularifolius
atgtctattcaaatcgacatcgagcctggtagcgtgcgggtgagcggaagttctcggcatatcattactgatggcgacgtgagaactttcggcctcaatgacaacgccctaaagaatgcggtgctagcacacttcgagagaaggcccaatgacgctttcctcagaagccccacgccttggggtgatctctataccacttacggttggccgcaggtccagacagtgcttgcggttcggagctcccaaattcttgaggagacctccagaccagtgatgcttgcttatcagaatttcgtcaacaataccaacacggaagcaacttatacagctaacatgtcgcgtgaggtgacaaattcgtcgtctaacacctggtccaatacacactccttatcgtttcaacaaaagatcaaatacggaatcaacttcgggattaccgctcaaggagaaactacattgagctataagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggaccgctggagtgatgaggagcggcgacatcagcaacaccagaactatcactgaggacatctcattgcagtcctattccaacggccgcgtcctgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 70 - DNA, 906 bp, Phlegmariurus nummularifolius
atgtctattcaaatcgacatcgagcctggtagcgtgcgggcgagcggaagttctcggcatatcattactgatggcgacgtgagaactttcggcctcaatgacaacgccctaaagaatgcggtgctagcacacttcgagagaaggcccaatgacgctttcctcagaagccccacgccttggggtgatctctataccacttacggttggccgcaggtccagacagtgcttgcggttcggagctcccaaattcttgaggagacctccagaccagtgatgcttgcttatcagaatttcgtcaacaataccaacacggaagcaacttatacagctaacatgtcgcgtgaggtgacaaattcgtcgtctaacacctggtccaatacacactccttatcgtttcaacaaaagatcaaatacggaatcaacttcgggattaccgctcaaggagaaactacattgagctataagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcctgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 71 - DNA, 906 bp, Phlegmariurus nummularifolius
atgtctattctaatcgacatcgagcctggcaacgtgcggatgagtggaagttctcggcttattattaccgatgccgacgtgagaactttcggcctcaatgacaacgccctaaagaatgccgtgctagcacacttcgaaagaaggcccaatgacgcctttctcagaagccccacgccttggggtgatctctataccacttacggttggcctcaggtccagacagtgcttgcggttcggagctcccaaattcttgaggagacctccagaccggtgatgcttgcttatcagaatttcgtcaacaacaccaacacggaagcaacttatacagctaacatgtctcgtgcggtgacaaattcgtcgtctaacgcctggtccaattcacactccttatcgtttcaacaaaagatcaaatacggaatcaacttcgggattaccgctcaaggagaaactacattgagctataagttttcgtttggtcaaagcgggacagagtcggtgagcaccacgatcagtacaggggcaggagtgagtgtggtagttggcccgcaccgaaccaagcacgcaatccttagcgcttcggaagggcggatgagagtccggatccgctatgaagcatatctgacggggtctaccgccgtaaattacaatccccggcacagaggacatcacttctggggtttgggaatcgctggagtgatgaggagcggcaacatcagcaacacgagaactatcactgaggacatctcattgctgtcctattccaacggcagcgtcgtgcttggggagggaccagcgccactttcattggtagaagaagtaaaaacgttgaacgagaaggcgacggcgccaattccagtgatagaatcaacagaaccattggaggaggaggaagaagagaataaggaa

SEQ ID NO: 72 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgcctttctcagaagccccacgccttggggtgatctctataccacttacggttggcctcaggtccagacagtgcttgcggttcggagctcccaaattcttgaggagacctccagaccggtgatgcttgcttatcagaatttcgtcaacaacaccaacacggaagcaacttatacagctaacatgtctcgtgcggtgacaaattcgtcgtctaacgcctggtccaattcacactccttatcgtttcaacaaaagatcaaatacggaatcaacttcgggattaccgctcaaggagaaactacattgagctataagttttcgtttggtcaaagcgggacagagtcggtgagcaccacgatcagtacaggggcaggagtgagtgtggtagttggcccgcaccgaaccaagcacgcaatccttagcgcttcggaagggcggatgagagtccggatccgctatgaagcatatctgacggggtctaccgccgtaaattacaatccccggcacagaggacatcacttctggggtttgggaatcgctggagtgatgaggagcggcaacatcagcaacacgagaactatcactgaggacatctcattgctgtcctattccaacggcagcgtcgtgcttggggagggaccagcgccactttcattggtagaagaagtaaaaacgttgaacgagaaggcgacggcgccaattccagtgatagaatcaacagaaccattggaggaggaggaagaagagaataaggaa

SEQ ID NO: 73 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgcctttctcagaagccccacgccttggggtgatctctataccacttacggttggcctcaggtccagacagtgcttgcggttcggagctcccaaattcttgaggagacctccagaccggtgatgcttgcttatcagaatttcgtcaacaacaccaacacggaagcaacttatacagctaacatgtctcgtgcggtgacaaattcgtcgtctaacgcctggtccaattcacactccttatcgtttcaacaaaagatcaaatacggaatcaacttcgggattaccgctcaaggagaaactacattgagctataagttttcgtttggtcaaagcgggacagagtcggtgagcaccacgatcagtacaggggcaggagtgagtgtggtagttggcccgcaccgaaccaagcacgcaatccttagcgcttcggaagggcggatgagagtccggatccgctatgaagcatatctgacggggtctaccgccgtaaattacaatccccggcacagaggacatcacttctggggtttgggaatcgctggagtgatgaggagcggcaacatcagcagcacgagaactatcactgaggacatctcattgctgtcctattccaacggcagcgtcgtgcttggggagggaccagcgccactttcattggtagaagaagtaaaaacgttgaacgagaaggcgacggcgccaattccagtgatagaatcaacagaaccattggaggaggaggaagaagagaataaggaa

SEQ ID NO: 74 - DNA, 906 bp, Phlegmariurus nummularifolius
atgtctattcaaatcgacatcgagcctggcaacgtgcgggtgagtggaagttctcagcatattattaccgatgccgatgtgagaacttttggcctcaatgacaacgccctaaagaatgccgtgcaagcacacttcgaaagaaggcccaatgacgcctttctcagaagccccacgccttggggtgatctctatacctcttacggttggccgcaggtccagacagtgcttgcggttcggagctcccaaattcttgaggaggcctccagaccggtgatgcttgcttatcagaatttcgtcaacaataccaacacggaagcagagtatgcagctaacatgtctcgtgggatgacaaattcgtcgtctaacacctggtccaatacgcactccttgacatttgaacaaaagatcaaatacggaatcaactttgggattactgctgaaggagaaactacactgagctatgagttttcgtttggtcaaagcgggacagagtctgtcagtaccactttgagtacaggggcaggagtgagtgtgatggttggccctcatcgaaccaagcacgtcatccttagcgcctccgaagggcggatgagagtccggatccgctatgaggcatatatgacggggtctaccgccgtgaattacaatccccggcacagaggacatcacttctggggtttggggatcgctggagtgatgaggagcggcaacatcagcaacaccagaactatcaccgaggacatctcattgcagtcctattccaacggcagcgtcgttcttggggagggaccagcgccaatttcattggtagaagaagtaacaacgttgaacgagaaggcgacggcgccaattccagtgatagaatcaacagaaccattggaggaggaggaagaagagaagaaggaa

SEQ ID NO: 75 - DNA, 906 bp, Phlegmariurus nummularifolius
atgtctattcaaatcgacatcgagcctggcaacgtgcgggtgagtggaagttctcagcatattattaccgatgccgatgtgagaacttttggcctcaatgacaacgccctaaagaatgccgtgcaagcacacttcgaaagaaggcccaatgacgcctttctcagaagccccacgccttggggtgatctctatacctcttacggttggccgcaggtccagacagtgcttgcggttcggagctcccaaattcttgaggagacctccagaccggtgatgcttgcttatcagaatttcgtcaacaataccaacacggaagcagagtatacagctaacatgtctcgtgagatgacaaattcgtcgtctaacacctggtccaatacgcactccttgacatttgaacaaaagatcaaatacggaatcaactttgggattactgctgaaggagaaactacactgagctatgagttttcgtttggtcaaagcgggacagagtctgtcagtaccactttgagtacaggggcaggagtgagtgtgatggttggccctcatcgaaccaagcacgtcatccttagcgcctccgaagggcggatgagagtccggatccgctatgaggcatatatgacggggtctaccgccgtgaattacaatccccggcacagaggacatcacttctggggtttggggatcgctggagtgatgaggagcggcaacatcagcaacaccagaactatcaccgaggacatctcattgcagtcctattccaacggcagcgtcgttcttggggagggaccagcgccaatttcattggtagaagaagtaacaacgttgaacgagaaggcgacggcgccaattccagtgatagaatcaacagaaccattggaggaggaggaagaagagaagaaggaa

SEQ ID NO: 76 - DNA, 906 bp, Phlegmariurus nummularifolius
atgtctattcaaatcgacatcgagcctggcaacgtgcgggtgagtggaagttctcggcatattattaccgatgccgatgtgagaacttttggcctcaatgacaacgccctaaagaatgccgtgcaagcacacttcgaaagaaggcccaatgacgcctttctcagaagccccacgccttggggtgatctctataccagttacggttggcctcaggtccagacagtgcttgcagttcggagctcccaaattcttgaggagacctccagaccggtgatgcttgcttatcagactttcgtcaacaacaccaacacggaagcaacttatacagctaacatgtctcgtgtgatgagaaattcgtcgtctaacgcctggtccaatacacactccttatcgtttcgacaaaagatcaaatacggaatcaacttcgggattaccgctcaaggagaaactacattgagctataagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcgcttctggggtttggggatcgctggagtgatgaggagcggcaacatcagcaacaccagaactatcactgaggacatctcattgcagtcctattccaacggccgcgtcgtgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 77 - DNA, 906 bp, Phlegmariurus nummularifolius
atgtctattcaaatcgacatcgagcctggcaacgtgcgggtgagtggaagttctcggcatattattaccgatgccgatgtgagaacttttggcctcaatgacaacgccctaaagaatgccgtgcaagcacacttcgaaagaaggcccaatgacgcctttctcagaagccccacgccttggggtgatctctataccagttacggttggcctcaggtccagacagtgcttgcagttcggagctcccaaattcttgaggagacctccagaccggtgatgcttgcttatcagactttcgtcaacaacaccaacacggaagcaacttatacagctaacatgtctcgtgtgatgagaaattcgtcgtctaacgcctggtccaatacacactccttatcgtttcaacaaaagatcaaatacggaatcaacttcgggattaccgctcaaggagaaactacattgagctataagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcgtgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 78 - DNA, 906 bp, Phlegmariurus nummularifolius
atgtctattcaaatcgacatcgagcctggcaacgtgcgggtgagtggaagttctcggcatattattaccgatgccgatgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcggttcggagctcccaaattcttgaggagacctccagaccggtgatgcttgattatcggaatttcgtcaacaacaccaacacggaagcaacttatacagctaacatgtctcgtgcgatgacaaattcgtcgtctaacacctggtccaatacacactccttatcatttcaacaaaagatcacatacggaatcaacttcgggattaccgctcaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttgggaatcgctggagtgatgaggagcggcaacatcagcaacacgagaactatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaaccattggaggaggaggaagaagagaagaaggaa

SEQ ID NO: 79 - DNA, 897 bp, Phlegmariurus nummularifolius
atgtctattcaaatcgacatcgagcctggtagcgtgcgggtgagcggaagttctcggcatatcattactgatggcgacgtgagaactttcggcctcaatgacaacgccctaaagaatgccgtgctagcacacttcgaaagaaggcccaatgacgccttcctcagaagccccatgccttagggtgatctctataccacttacggttggcctcaggtccagacagtgcttgcggttcggagctcccaaattcttgaggagacctccagaccggtgatgcttgattatcagaatttcgtcaacaacaccaacacggaagcaacttatccagctaacatgtctcgtgcggtgacaacttcgttgcctaacacctggtccaatacacactccttagcatttgaacaaaagatcaaatacggaatcaacttcgggattaccgctcaaggaggaactacattgagctataagttttcgtttggtcaaagctggacagagtcggtgagcatcacgatatcggcagtagagagtgtggtagttggcccgcaccaaaccaagcacgcaatccttagcgctttggaagggcggatgagagtccggatccgttatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaaccattggaggaggaggaagaagagaaggac

SEQ ID NO: 80 - DNA, 897 bp, Phlegmariurus nummularifolius
atgtctattcaaatcgacatcgagcctggtagcgtgcgggtgagcggaagttctcggcatatcattactgatggcgacgtgagaactttcggcctcaatgacaacgccctaaagaatgccgtgctagcacacttcgaaagaaggcccaatgacgccttcctcagaagccccatgccttagggtgatctctataccacttacggttggcctcaggtccagacagtgcttgcggttcggagctcccaaattcttgaggagacctccagaccggtgatgcttgattatcagaatttcgtcaacaacaccaacacggaagcaacttatccagctaacatgtctcgtgcggtgacaacttcgttgtctaacacctggtccaatacacactccttagcatttgaacaaaagatcaaatacggaatcaacttcgggattaccgctcaaggaggaactacattgagctataagttttcgtttggtcaaagctggacagagtcggtgagcatcacgatatcggcagtagagagtgtggtagttggcccgcaccaaaccaagcacgcaatccttagcgctttggaagggcggatgagagtccggatccgttatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaaccattggaggaggaggaagaagagaaggac

SEQ ID NO: 81 - DNA, 906 bp, Phlegmariurus nummularifolius
atgtctattcaaatcgacatcgagcctggcaacgtgcgggtgagtggaagttctcagcatattattaccgatgccgatgtgagaacttttggcctcaatgacaacgccctaaagaatgccgtgcaagcacacttcgaaagaaggcccaatgacgccttcctcagaagccccacgccttggggtgatctctataccagttacggttggcctcaggtccagacagtgcttgcagttcggagctcccaaattcttgaggagacctccagaccggtgatgcttgcttatcagaatttcgtcaacaataccaacacggaagcaacttatacagctgacatgtctcgtgcgatgacaaattcgtcgtctaacacctggtccaatacacactccttatcatttcaacaaaagatcacatacggaatcaacttcgggattacggctgaaggagaaactacattgagctatcagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgttatgaagcatatctgacggggtctaccgccgtaaattacaatccccggcacagaggacatcacttctggggtttggggatcgctggagtgatgaggagcggcaacatcagcaacacgagaactatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaaccattggaggaggaggaagaagagaagaaggaa

SEQ ID NO: 82 - DNA, 906 bp, Phlegmariurus nummularifolius
atgtctattcaaatcgacatcgagcctggcaacgtgcgggtgagtggaagttctcagcatattattaccgatgccgatgtgagaacttttggcctcaatgacaacgccctaaagaatgccgtgcaagcacacttcgaaagaaggcccaatgacgccttcctcagaagccccacgccttggggtgatctctataccagttacggttggcctcaggtccagacagtgcttgcagttcggagctcccaaattcttgaggagacctccagaccggtgatgcttgcttatcagaatttcgtcaacaataccaacacggaagcaacttatacagctgacatgtctcgtgcgatgacaaattcgtcgtctaacacctggtccaatacacactccttatcatttcaacaaaagatcacatacggaatcaacttcgggattacggctgaaggagaaactacattgagctatcagttttcgtttggtcaaagtaggacagagtcggtgagcaccacgatcagtacaggggcaggagtgagtgtggtagttggcccgcaccgaaccaagcacgcaatccttagcgcttcggaagggcggatgagagtccggatccgttatgaagcatatctgacggggtctaccgccgtaaattacaatccccggcacagaggacatcacttctggggtttggggatcgctggagtgatgaggagcggcaacatcagcaacacgagaactatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaaccattggaggaggaggaagaagagaagaaggaa

SEQ ID NO: 83 - DNA, 906 bp, Phlegmariurus nummularifolius
atgtctattcaaatcgacatcgagcctggcaacgtgcgggtgagtggaagttctcggcatattattaccgatgccgatgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcggttcggagctcccaaattcttgaggagacctccagaccggtgatgcttgattatcggaatttcgtcaacaacaccaacacggaagcaacttatacagctaacatgtctcgttcggtgacaaattcgtcgtctaacacctggtccaatacacactccttagcatttgaacaaaagatcaaatacggaatcaactttgggattactgctgaaggagaaactacactgagctatgagttttcgtttggtcaaagcgggacagagtctgtcagtaccactttgagtacaggggcaggagtgagtgtgatggttggccctcatcgaaccaagcacgtcatccttagcgcctccgaagggcggatgagagtccggatccgctatgaggcatatatgacggggtctaccgccgtgaattacaatccccggcacaacggacatcatttctggggtttgggaatcgctggagtgatgaggagcggcaacatcagcaacacgagaactatcactgaggacatctcattgcagtcctattccaacagcagcgttgtgcttggggagggaccagcgccaatttcattggtagaagcagtagaaacattgaacgagaaggcgacggcgccacctccagtggtagaatcaataccaatggaggaggaggaggaagaagagaagaaggaa

SEQ ID NO: 84 - DNA, 906 bp, Phlegmariurus nummularifolius
atgtctattcaaatcgacatcgagcctggcagcgtgcgggtgagtggaagttctcagcatattattaccgatgccgatgtgagaacttttggcctcaatgacaacgccctaaagaatgccgtgcaagcacacttcgaaagaaggcccaatgacgcctttctcagaagccccacgccttggggtgatctctataccagttacggttggcctcaggtccagacagtgcttgcagttcggagctcccaaattcttgaggagacctccagaccggtgatgcttgcttatcagactttcgtcaacaacaccaacacggaagcaacttatacagctaacatgtctcgtgtgatgagaaattcgtcgtctaacgcctggtccaatacacactccttatcgtttcaacaaaagatcaaatacggaatcaacttcgggattaccgctcaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcgtgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 85 - DNA, 906 bp, Phlegmariurus nummularifolius
atgtctattcaaatcgacatcgagcctggtagcgtgcgggtgagcggaagttctcggcatatcattactgatggcgacgtgagaactttcggcctcaatgacaacgccctaaagaatgcggtgctagcacacttcgagagaaggcccaatgacgctttcctcagaagccccacgccttggggtgatctctataccacttacggttggccgcaggtccagacagtgcttgcggttcggagctcccaaattcttgaggagacctccagaccagtgatgcttgcttatcagaatttcgtcaacaataccaacacggaagcaacttatacagctaacatgtcgcgtgaggtgacaaattcgtcgtctaacacctggtccaatacacactccttgacattcgaacagaagatcaaatacggaatcaacttcgggattacggctgaaggagaaactacattgagctatgagttttcgtttggtcagagtgggacagagtcggtgagcaccacgatcagtacaggggcaggagtgagtgtggtagttggcccgcaccgaaccaagcacgcaatccttagcgcttcggaagggcggatgagagtccggatccgttatgaagcatatctgacggggtctaccgccgtaaattacaatccccggcacagaggacatcacttctggggtttgggaatcgctggagtgatgaggagcggcaacatcagcaacacgagaactatcactgaggacatctcattgctgtcctattccaacggcagcgtcgtgcttggggagggaccagcgccactttcattggtagaagaagtaaaaacgttgaacgagaaggcgacggcgccaattccagtgatagaatcaacagaaccattggaggaggaggaagaagagaagaaggaa

SEQ ID NO: 86 - DNA, 903 bp, Phlegmariurus nummularifolius
atgtctattcaaatcgacatcgagcctggcaacgtgcgggtgagtggaagttctcagcatattattaccgatgccgatgtgagaacttttggcctcaatgacaacgccctaaagaatgccgtgcaagcacacttcgaaagaaggcccaatgacgcctttctcagaagccccacgccttggggtgatctctataccagttacggttggcctcaggtccagacagtgcttgcagttcggagctcccaaattcttgaggagacctccagaccggtgatgcttgcttatcagactttcgtcaacaacaccaacacggaagcaacttatacagctaacatgtctcgtgtgatgagaaattcgtcgtctaacgcctggtccaatacacactccttatcgtttcaacaaaagatcaaatacggaatcaacttcgggattacggctgaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaaccattggaggaggaggaagaagagaaggac

SEQ ID NO: 87 - DNA, 903 bp, Phlegmariurus nummularifolius
atgtctattcaaatcgacatcgagcctggcaacgtgcgggtgagtggaagttctcagcatattattaccgatgccgatgtgagaacttttggcctcaatgacaacgccctaaagaatgccgtgcaagcacacttcgaaagaaggcccaatgacgcctttctcagaagccccacgccttggggtgatctctataccagttacggttggcctcaggtccagacagtgcttgcagttcggagctcccaaattcttgaggagacctccagaccggtgatgcttgcttatcagactttcgtcaacaacaccaacacggaagcagcttatacagctaacatgtctcgtgtgatgagaaattcgtcgtctaacgcctggtccaatacacactccttatcgtttcaacaaaagatcaaatacggaatcaacttcgggattacggctgaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaaccattggaggaggaggaagaagagaaggac

SEQ ID NO: 88 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaataacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcaaatacggaatcaacttcgggattaccgctgaaggagaaactacattgagctatcagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcaccgaggacatctcattgcagtcctattccaacggcagcgtcgttcttggggagggaccagcgccaatttcattggtagaagaagtaacaacgttgaacgagaaggcgacggcgccaattccagtgatagaatcaacagaaccattggaggaggaggaagaagagaagaaggaa

SEQ ID NO: 89 - DNA, 906 bp, Phlegmariurus nummularifolius
atgtctattcaaatcgacatccagcctggcaacgtgcgggtgagtggaagttctcggcatattattaccgatgccgatgtgagaacttttggcctcaatgacaacgccctaaagaatgccgtgcaagcacacttcgaaagaaggcccaatgacgcctttctcagaagccccacgccttggggtgatctctataccagttacggttggcctcaggtccagacagtgcttgcagttcggagctcccaaattcttgaggagacctccagaccggtgatgcttgcttatcagactttcgtcaacaacaccaacacggaagcaacttatacagctaacatgtctcgtgcgatgacaaattcgtcgtctaacacctggtccaatacacactccttatcatttcaacaaaagatcaaatacggaatcaacttcgggattaccgctgaaggagaaactacattgagctatcagttttcgtttggtcaaagcgggacagagtcggtgagcaccacgatcagtacaggggcagaagtgagtgtggtagttggcccgcaccgaaccaagcacgcaatccttagcgcctcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcaccgaggacatctcattgcagtcctattccaacggcagcgtcgttcttggggagggaccagcgccaatttcattggtagaagaagtaacaacgttgaacgagaaggcgacggcgccaattccagtgatagaatcaacagaaccattggaggaggaggaagaagagaagaaggaa

SEQ ID NO: 90 - DNA, 906 bp, Phlegmariurus nummularifolius
atgtctattcaaatcgacatccagcctggcaacgtgcgggtgagtggaagttctcggcatattattaccgatgccgatgtgagaacttttggcctcaatgacaacgccctaaagaatgccgtgcaagcacacttcgaaagaaggcccaatgacgcctttctcagaagccccacgccttggggtgatctctataccagttacggttggcctcaggtccagacagtgcttgcagttcggagctcccaaattcttgaggagacctccagaccggtgatgcttgcttatcagactttcgtcaacaacaccaacacggaagcaacttatacagctaacatgtctcgtgcgatgacaaattcgtcgtctaacacctggtccaatacacactccttatcatttcaacaaaagatcaaatacggaatcaacttcgggattaccgctgaaggagaaactacattgagctatcagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcaccgaggacatctcattgcagtcctattccaacggcagcgtcgttcttggggagggaccagcgccaatttcattggtagaagaagtaacaacgttgaacgagaaggcgacggcgccaattccagtgatagaatcaacagaaccattggaggaggaggaagaagagaagaaggaa

SEQ ID NO: 91 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaataccaacacggaagcaacttatacagctgacatgtctcgtgcgatgacaaattcgtcgtctaacacctggtccaatacacactccttatcatttcaacaaaagatcacatacggaatcaacttcgggattacggctgaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcgtgcttggggagggaccagcgccactttcattggtagaagaagtaaaaacgttgaacgagaaggcgacggcgccaattccagtgatagaatcaacagaaccattggaggaggaggaagaagagaagaaggaa

SEQ ID NO: 92 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaataccaacacggaagcaacttatacagctgacatgtctcgtgcgatgacaaattcgtcgtctaacacctggtccaatacacactccttatcatttcaacaaaagatcacatacggaatcaacttcgggattacggctgaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggcagcgtcgtgcttggggagggaccagcgccactttcattggtagaagaagtaaaaacgttgaacgagaaggcgacggcgccaattccagtgatagaatcaacagaaccatcggaggaggaggaagaagagaagaaggaa

SEQ ID NO: 93 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcagttcggagctcccaaattcttgaggagacctccagaccggtgatgcttgcttatcagaatttcgtcaacaataccaacacggaagcaacttatacagctgacatgtctcgtgcgatgacaaattcgtcgtctaacacctggtccaatacacactccttatcatttcaacaaaagatcacatacggaatcaacttcgggattacggctgaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggaacggcaacatcagcaacaccagaactatcactgaggacatctcattgcagtcctattccaacggcagcgtcgtgcttggggagggaccagcgccactttcattggtagaagaagtaaaaacgttgaacgagaaggcgacggcgccaattccagtgatagaatcaacagaaccattggaggaggaggaagaagagaagaaggaa

SEQ ID NO: 94 - DNA, 906 bp, Phlegmariurus nummularifolius
atggcttttgtaatcgacatcgagcctggcaacgtgcgggtgagtggaagttctcggcatattattaccgatgccgatgtgagaacttttggcctcaatgacaacgccctaaagaatgccgtgcaagcacacttcgaaagaaggcccaatgacgccttcctcagaagccccacgccttggggtgatctctataccagttacggttggcctcaggtccagacagtgcttgcagttcggagctcccaaattcttgaggagacctccagaccggtgatgcttgcttatcagaatttcgtcaacaacaccaacacggaagcaacttatacagctaacatgtctcgtgcgatgacaaattcgtcgtctaacacctggtccaatacacactccttatcatttcaacaaaagatcaaatacggaatcaacttcgggattaccgctgaaggagaaactacattgagctatcagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgctatgaagcatacctgacggggtctaccgccgtaaattacaatccccggcacagaggacatcacttctggggtttggggatcgctggagtgatgaggagcggcaacatcagcaacaccagaactatcaccgaggacatctcattgcagtcctattccaacggcagcgtcgttcttggggagggaccagcgccaatttcattggtagaagaagtaaaaacgttgaacgagaaggcgacggcgccaattccagtgatagaatcaacagaaccattggaggaggaggaagaagagaagaaggaa

SEQ ID NO: 95 - DNA, 906 bp, Phlegmariurus nummularifolius
atgtctattcaaatcgacatcgagcctggcaacgtgcgggtgagtggaagttctcggcatattattaccgatgccgatgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcggttcggagctcccaaattcttgaggagacctccagaccggtgatgcttgcttatcagaatttcgtcaacaacagcaacacggaagcaacttatacagctaacatgtctcgtgcggtgacaaattcgtcgtctaacacctggtccaatacacactccttagcatttgaacaaaagatcaaatacggaatcaacttcgggattaccgctgaaggagaaactacattgagctatgagttttcgtttggtcaaagcgggacggagtcggtgagcaccacgatcagtacaggggcaggagtgagtgtggtagttggcccgcaccgaaccaagcacgcaatccttagcgcttcggaagggcggatgagagtccggatccgctatgaagcatatctgacggggtctaccgccgtaaattacaatccccggcacagaggacatcacttctggggtttgggaatcgctggagtgatgaggagcggcaacatcagcaacacgagaactatcactgaggacatctcattgctgtcctattccaacggcagcgtcgtgcttggggagggaccagcgccactttcattggtagaagaagtaaaaacgttgaacgagaaggcgacggcgccaattccagtgatagggtcaacagaaccattggaggaggaggaagaagagaagaaggaa

SEQ ID NO: 96 - DNA, 906 bp, Phlegmariurus nummularifolius
atgtctattcaaatcgacatcgagcctggcaacgtgcgggtgagtggaagttctcggcatattattaccgatgccgatgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcggttcggagctcccaaattcttgaggagacctccagaccggtgatgcttgcttatcagaatttcgtcaacaacagcaacacggaagcaacttatacagctaacatgtctcgtgcggtgacaaattcgtcgtctaacacctggtccaatacacactccttagcatttgaacaaaagatcaaatacggaatcaacttcgggattaccgctgaaggagaaactacattgagctatgagttttcgtttggtcaaagcgggacagagtcggtgagcaccacgatcagtacaggggcaggagtgagtgtggtagttggcccgcaccgaaccaagcacgcaatccttagcgcttcggaagggcggatgagagtccggatccgctatgaagcatatctgacggggtctaccgccgtaaattacaatccccggcacagaggacatcacttctggggtttgggaatcgctggagtgatgaggagcggcaacatcagcaacacgagaactatcactgaggacatctcattgctgtcctattccaacggcagcgtcgtgcttggggagggaccagcgccactttcattggtagaagaagtaaaaacgttgaacgagaaggcgacggcgccaattccagtgatagagtcaacagaaccattggaggaggaggaagaagagaagaaggaa

SEQ ID NO: 97 - DNA, 906 bp, Phlegmariurus nummularifolius
atgtctattcaaatcgacatcgagcctggcaacgtgcgggtgagtggaagttctcggcatattattaccgatgccgatgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcggttcggagctcccaaattcttgaggagacctccagaccggtgatgcttgcttatcagaatttcgtcaacaacagcaacacggaagcaacttatacagctaacatgtctcgtgcggtgacaaattcgtcgtctaacacctggtccaatacacactccttagcatttgaacaaaagatcaaatacggaatcaacttcgggattaccgctgaaggagaaactacattgagctatgagttttcgtttggtcaaagcgggacagagtcggtgagcaccacgatcagtacaggggcaggagtgagtgtggtagttggcccgcaccgaaccaagcacgcaatccttagcgcttcggaagggcggatgagagtccggatccgctatgaagcatatctgacggggtctaccgccgtaaattacaatccccggcacagaggacatcacttctggggttcgggaatcgctggagtgatgaggagcggcaacatcagcaacacgagaactatcactgaggacatctcattgctgtcctattccaacggcagcgtcgtgcttggggagggaccagcgccactttcattggtagaagaagtaaaaacgttgaacgagaaggcgacggcgccaattccagtgatagagtcaacagaaccattggaggaggaggaagaagagaagaaggaa

SEQ ID NO: 98 - DNA, 906 bp, Phlegmariurus nummularifolius
atgtctattcaaatcgacatcgagcctggcaacgtgcgggtgagtggaagttctcggcatattattaccgatgccgacgtgagaactttcggcctcaatgacaacgccctaaagaatgccgtgctagcacacttcgaaagaaggcccaatgacgccttcctcagaagccccacgccttggggtgatctctataccacttacggttggccgcaggtccagacagtgcttgcggttcggagctcccaaattcttgaggagacctccagaccagtgatgcttgcttatcagaatttcgtcaacaataccaacacggaagcaacttatacagctaacatgtcgcgtgaggtgacaaattcgtcgtctaacacctggtccaatacacactccttgacattcgaacagaagatcaaatacggaatcaacttcgggattacggctgaaggagaaactacattgagctatgagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccgttatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggcagcatcgtgcttggggagggaccagcgccaatttcattggtagaagaagtaaaaacgttgaacgagaaggcgacggcgccaattccagtgatagaatcaacagaaccattggaggaggaggaagaagagaagaaggaa

SEQ ID NO: 99 - DNA, 906 bp, Phlegmariurus nummularifolius
atgtctattcaaatcgacatcgagcctggcaacgtgcgggtgagtggaagttctcggcatattattaccgatgccgatgtgagaacttttggcctcaatgacaacgccctaaagaatgccgtgcaagcacacttcgaaagaaggcccaatgacgccttcctcagaagccccacgccttggggtgatctctataccagttacggttggcctcaggtccagacagtgcttgcggttcggagctcccaaattcttgaggagacctccagaccggtgatgcttgcttatcagaatttcgtcgacaacaccaacacggaagcaacttatacagctaacatgtctcgtgcggtgacaaattcgtcgtctaacacctggtccaatacacactccttagcatttgaacaagagatcaaatacggaatcaacttcgggattaccgctcaaggagaaactacattgagctatgagttttcgtttggtcaaagcgggacagagtcggtgagcaccaagatcagtacaggggcaggagtgagtgtggtagttggcccgcaccgaaccaagcacgcaatccttagcgcttcggaagggcggatgagagtccggatccgctatgaagcatatctgacggggtctaccgccgtaaattacaatccccggcacagaggacatcacttctggggtttgggaatcgctggagtgatgaggagcggcaacatcagcaatacgagaactatcactgaggacatctcattgctgtcctattccaacggcagcgtcgtgcttggggagggaccagcgccactttcattggtagaagaagtaaaaacgttgaacgagaaggcgacggcgccaattccagtgatagaatcaacagaaccattggaggaggaggaagaagagaagaaggaa

SEQ ID NO: 100 - DNA, 906 bp, Phlegmariurus nummularifolius
atgtctattcaaatcgacatcgagcctggcaacgtgcgggtgagtggaagttctcggcatattattaccgatgccgatgtgagaacttttggcctcaatgacaacgccctaaagaatgccgtgcaagcacacttcgaaagaaggcccaatgacgccttcctcagaagccccacgccttggggtgatctctataccagttacggttggcctcaggtccagacagtgcttgcggttcggagctcccaaattcttgaggagacctccagaccggtgatgcttgcttatcagaatttcgtcaacaacaccaacacggaagcaacttatacagctaacatgtctcgtgcggtgacaaattcgtcgtctaacacctggtccaatacacactccttagcatttgaacaaaagatcaaatacggaatcagcttcgggattaccgctcaaggagaaactacattgagctatgagttctcgtttggtcaaagcgggacagagtcggtgagcaccaagatcagtacaggggcaggagtgagtgtggtagttggcccgcaccgaaccaagcacgcaatccttagcgcttcggaagggcggatgagagtccggatccgctatgaagcatatctgacggggtctaccgccgtaaattacaatccccggcacagaggacatcacttctggggtttgggaatcgctggagtgatgaggagcggcaacatcagcaacacgagaactatcactgaggacatctcattgctgtcctattccaacggcagcgtcgtgcttggggagggaccagcgccactttcattggtagacgaagtaaaaacgttgaacgagaaggcgacggcgccaattccagtgctagaatcaacagaaccattggaggaggaggaagaagataagaaggaa

SEQ ID NO: 101 - DNA, 906 bp, Phlegmariurus nummularifolius
atgtctattcaaatcgacatcgagcctggcaacgtgcgggtgagtggaagttctcggcatattattaccgatgccgatgtgagaacttttggcctcaatgacaacgccctaaagaatgccgtgcaagcacacttcgaaagaaggcccaatgacgccttcctcagaagccccacgccttggggtgatctctataccagttacggttggcctcaggtccagacagtgcttgcggttcggagctcccaaattcttgaggagacctccagaccggtgatgcttgcttatcagaatttcgtcaacaacaccaacacggaagcaacttatacagctaacatgtctcgtgcggtgacaaattcgtcgtctaacacctggtccaatacacactccttagcatttgaacaaaagatcaaatacggaatcaacttcgggattaccgctcaaggagaaactacattgagctatgagttttcgtttggtcaaagcgggacagagtcggtgagcaccaagatcagtacaggggcaggagtgagtgtggtagttggcccgcaccgaaccaagcacgcaatccttagcgcttcggaagggcggatgagagtccggatccgctatgaagcatatctgacggggtctaccgccgtaaattacaatccccggcacagaggacatcacttctggggtttgggaatcgctggagtgatgaggagcggcaacatcagcaacacgagaactatcactgaggacatctcattgctgtcctattccaacggcagcgtcgtgcttggggagggaccagcgccactttcattggtagaagaagtaaaaacgttgaacgagaaggcgacggcgccaattccagtgatagaatcaacagaaccattggaggaggaggaagaagagaagaaggaa

SEQ ID NO: 102 - DNA, 765 bp, Huperzia phlegmaria
atgtctattcaaatcgacatcgagcctggcagggtgcgggtgagtggaagttctcggcatatcattaccgatgccgatgtgagaactttcggcctcaatgacaacgccctcaagaatgctgtgctagcacacctcggtagaaggcccaatgacgccttcctcagaagccccacgccttggggtgatctctatagcacttacggttggccgcaggtccagacagtgcttgcggttcggagctcccaaattcttgaggagaccaccagaccggtgatgcttgcttaccagaatttcgtcaacaataccaacacggaagcaacttatacagctaacatgtcccgtgagatgacaaattcgtcgtctaacacctggtccaatacgcactccttgagttttgaacagaagatcaaatacggaatcaactttgggattactgctgttggagaaactacattgagctatgagttttcgttcggtcaaagcgggaccgagtctgtcagtaccactttgagtacaggggcgggagtgagtgtggtagttggcccgcaacgaaccaagcacgcaatccttagtgcctccgaagggcggatgagagtccggatccgctacgaggcatatctgacggggtctaccgccgtaaattacaatccccggcacaatggacatcatttctggggtttggggatcgctggagtgatgaggagcggcaacatcagcaacacgagaactatcacgggatcccaccatcaccatcaccatcaccat

SEQ ID NO: 103 - DNA, 765 bp, Huperzia phlegmaria
atgtctattcaaatcgacatcgagcctggcaccgtgcgggtgagtggaagttctcggcatatcattaccgatgccgatgtgagaactttcggcctcaatgacaacgccctcaagaatgctgtgctagcacacctcggtagaaggcccaatgacgccttcctcagaagccccacgccttggggtgatctctatagcacttacggttggccgcaggtccagacagtgcttgcggttcggagctcccaaattcttgaggagacctccagaccggtgatgcttgcttaccagaatttcgtcaacaataccaacacggaagcaacttatacagctaacatgtcccgggagatgacaaattcgtcgtctaacacctggtcgaatacgcactccttgagttttgaacagaagatcaaatacggaatcaactttgggattactgctgtcggagaaactacgttgagctacgagttttcgtttggtcaaagcgggaccgagtcggtcagtaccactttgagtacaggggcgggagtgagtgtggtagttggcccgcaacgaaccaagcacgcaatccttagcgcctccgaagggcggatgagagtccggatccaatatgaggcatatctgacggggtctaccgccgtgaattacaatccccggcacaatggacatcatttctggggtttggggatcgctggagtgatgaggagcggcaacatcagcaacacgagaactatcacgggatcccaccatcaccatcaccatcaccat

SEQ ID NO: 104 - DNA, 771 bp, Huperzia phlegmaria
atgtctattcaaatcgacatcgagcctggcagcgtgcgggtgagtggaagttctcggcatatcattaccgatgccgatgtgagaactttcggcctcaatgacaacgccctcaagaatgctgtgctggcacacttcggtagaaggcccaatgacgccttcctcagaagccccacgccttggggtgatctctatagcacttacggttggccgcaggtccagacagtgcttgcggttcggagctcccaaattcttgaggagaccaccagaccggtgatgcttgcttaccagaatttcgtcaacaataccaacacggaagcaacttatacagctaacatgtcccgtgagatgacaaattcgtcgtctaacacctggtccaatacgcactccttgagttttgaacagaagatcaaatacggaatcaactttgggattactgctgttggagaaactacattgagctatgagttttcgtttggtcaaagcgggacagagtctgtcagtaccactttgagttcaggggcaggagtgagtgtggtagttggcccgcaccaaaccaagcacgcaatcctcagcgcctccgaagggcggatgagagtccggatccgctacgaggcatatctgacggggtctaccgccgtaaattacaatccccggcacaatggacatcatttctggggtttggggatcgctggagtgatgaggagcggcaacatcagcaacacgagaactatcacgggatcccaccatcaccatcaccatcaccatcaccat

SEQ ID NO: 105 - DNA, 777 bp, Huperzia phlegmaria
atgtctattcaaatcgacatcgagcctggcagcgtgcgggtgagtggaagttctcggcatatcattaccgatgccgatgtgagaactttcggcctcaatgacaacgccctcaagaatgctgtgctagcacacctcggtagaaggcccaatgacgccttcctcagaagccccacgccttggggtgatctctatagcacttacggttggccgcaggtccagacagtgcttgcggttcggagctcccaaattcttgaggagaccaccagaccggtgatgcttgcttaccagaatttcgtcaacaataccaacacggaagcaacttatacagctaacatgtcccgtgagatgacaaattcgtcgtctaacacctggtccaatacgcactccttgagttttgaacagaagatcaaatacggaatcaactttgggattactgctgttggagaaactacattgagctatgagttttcgttcggtcaaagcgggaccgagtctgtcagtaccactttgagtacaggggcgggagtgagtgtggtagttggcccgcaacgaaccaagcacgcaatccttagtgcctccgaagggcggatgagagtccggatccgctacgaggcatatctgacggggtctaccgccgtaaattacaatccccggcacaatggacatcatttctggggtttggggatcgctggagtgatgaggagcggcaacatcagcaacacgagaactatcacgggatcccaccatcaccatcaccatcaccatcaccatcaccat

SEQ ID NO: 106 - DNA, 765 bp, Huperzia phlegmaria
atgtctattcaaatcgacatcgagcctggcaacgtgcgggtgagtggaagttcttggcatatcattaccgatgccgatgtgagaactttcggcctcaacgacaacgccctcaagaatgctgtgctggcacacttcggtagaaggcccaatgacgccttcctcagaagccccacgccttggggtgatctctataccacttacggttggccgcaggtccagacagtgcttgcggttcggagctcccaaattcttgaggagaccaccagaccggtgatgcttgcttaccagaatttcgtcaacaataccaacacggaagcaacttatacagctaacatgtcccgtgagatgacaaattcgtcgtctaacacctggtccaatacgcactccttgagttttgaacagaagatcaaatacggaatcaactttgggattactgctgttggagaaactacattgagctatgagttttcgttcggtcaaagcgggaccgagtctgtcagtaccactttgagtacaggggcgggagtgagtgtggtagttggcccgcaacgaaccaagcacgcaatccttagtgcctccgaagggcggatgagagtccggatccgctacgaggcatatctgacggggtctaccgccgtaaattacaatccccggcacaatggacatcatttctggggtttggggatcgctggagtgatgaggagcggcaacatcagcaacacgagaactatcacgggatcccaccatcaccatcaccatcaccat

SEQ ID NO: 107 - DNA, 771 bp, Huperzia phlegmaria
atgtctattcaaatcgacatcgagcctggcagcgtgcgggtgagtggaagttctcggcatatcattaccgatgccgatgtgagaactttcggcctcaatgacaacgccctcaagaatgctgtgctggcacacttcggtagaaggcccaatgacgccttcctcagaagccccacgccttggggtgatctctataccacttacggttggccgcaggtccagacagtgcttgcggttcggagctcccaaattcttgaggagtcctccagaccggtgatgcttgcttaccagaatttcgtcaacaataccaacacggaagcaacttatacagctaacatgtcccgggagatgacaaattcgtcgtctaacacctggtcgaatacgcactccttgagttttgaacagaagatcaaatacggaatcaactttgggattactgctgtcggagaaactacgttgagctacgagttttcgtttggtcaaagcgggaccgagtcggtcagtaccactttgagtacaggggcgggagtgagtgtggtagttggcccgcaacgaaccaagcacgcaatccttagcgcctccgaagggcggatgagagtccggatccaatatgaggcatatctgacggggtctaccgccgtaaattacaatccccggcacaatggacatcatttctggggtttggggatcgctggagtgatgaggagcggcaacatcagcaacacgagaactatcacgggatcccaccatcaccatcaccatcaccatcaccat

SEQ ID NO: 108 - DNA, 765 bp, Huperzia phlegmaria
atgtctattcaaatcgacatcgagcctggcaacgtgcgggtgagtggaagttctcggcatatcattaccgatgccgatgtgagaactttcggcctcaatgacaacgccctcaagaatgctgtgctagcacacttaggcaggaggcccaatgacgccttcctcagaagccccacaccttggggtgatctctatagcacttacggttggccccaggtccagacagtgcttgcggttcggagctcccaaattcttgaggagacctccagaccggtgatgcttgcttatcagaatttcgtcaacaataccaacacggaagcaacttatacagctagcatgtctcgtgcggtgacaaattcgtcgtctaacacctggtccaatacgcactccttgacatttgaacaaaagatcaaatacggaatcaactttgggattaccgctgaaggagaaactacattgagctatgagttttcgtttggtcaaagcgggacagagtctgtcagtaccactttgagtacaggggcaggagttagtgtggttgttgccccgcatcgaaccaagcacgcaatccttagcgcctccgaagggcggatgagagtccggatccgctatgaggcatatttgacggggtctaccgccgtgaattacaatccccggcacaatggacatcatttctggggcttggggatcgctggagtgatgaggagcggcaacatcagcaacacgagaactatcacgggatcccaccatcaccatcaccatcaccat

SEQ ID NO: 109 - DNA, 771 bp, Huperzia phlegmaria
atgtctattcaaatcgacatcgagcctggcagcgtgcgggtgagtggaagttctcggcatatcattaccgatgccgatgtgagaactttcggcctcaatgacaacgccctcaagaatgctgtgctagcacacctcggtagaaggcccaatgacgccttcctcagaagccccacgccttggggtgatctctatagcacttacggttggccgcaggtccagacagtgcttgcggttcggagctcccaaattcttgaggagaccaccagaccggtgatgcttgcttaccagaatttcgtcaacaataccaacacggaagcaacttatacagctaacatgtcccgtgagatgacaaattcgtcgtctaacacctggtccaatacgcactccttgagttttgaacagaagatcaaatacggaatcaactttgggattactgctgttggagaaactacattgagctatgagttttcgttcggtcaaagcgggaccgagtctgtcagtaccactttgagtacaggggcgggagtgagtgtggtagttggcccgcaacgaaccaagcacgcaatccttagtgcctccgaagggcggatgagagtccggatccgctacgaggcatatctgacggggtctaccgccgtaaattacaatccccggcacaatggacatcatttctggggtttggggatcgctggagtgatgaggagcggcaacatcagcaacacgagaactatcacgggatcccaccatcaccatcaccatcaccatcaccat

SEQ ID NO: 110 - DNA, 777 bp, Huperzia phlegmaria
atgtctattcaaatcgacatcgagcctggcagcgtgcgggtgagtggaagttcgcggcatatcattaccgatgccgatgtgagaactttcggcctcaatgacaacgccctcaagaatgctgtgctagcacacttcggcaggaggcccaatgacgccttcctcagaagccccacaccttggggtgatctctatagcacttacggttggccgcaggtccagacagtgcttgcggttcggagctcccaaattcttgaggagacctccagaccggtgatgcttgcatatcagaatttcgtcaacaataccaacaccgaagcaacttatacagctaacatgtcgcgtgtggtgacaaattcgtcgtctaacacctggtccaatacgcactccttcacatttgaacaaaagatcaaatatggaatcaactttgggattactgctgttggagaaactacattgagctatgagttttcgttcggtcaaagcgggaccgagtctgtcagtaccactttgagtacaggggcgggagtgagtgtggtagttggcccgcaacgaaccaagcacgcaatccttagtgcctccgaagggcggatgagagtccggatccgctacgaggcatatctgacggggtctaccgccgtgaattacaatccccggcacaatggacatcatttctggggtttggggatcgctggagtgatgaggagcggcaacatcagcaacacgagaactatcacgggatcccaccatcaccatcaccatcaccatcaccatcaccat

SEQ ID NO: 111 - DNA, 765 bp, Huperzia phlegmaria
atgtctattcaaatcgacatcgagcctggcagcgtgcgggtgagtggaagttctcggcatatcattaccgatgccgatgtgagaactttcggcctcaatgacaacgccctcaagaatgctgtgctggcacacttcggtagaaggcccaatgacgccttcctcagaagccccacgccttggggtgatctctataccacttacggttggccccaggtccagacagtgcttgcggttcggagctcccaaattcttgaggagacctccagaccggtgatgcttgcttatcagaatttcgtcaacaataccaacacggaagcaacttatacagctagcatgtctcgtgcggtgacaaattcgtcgtctaacacctggtccaatacgcactccttgacatttgaacaaaagatcaaatacggaatcaactttgggattaccgctgaaggagaaactacattgagctatgagttttcgttcggtcaaagcgggaccgagtctgtcagtaccactttgagtacaggggcgggagtgagtgtggtagttggcccgcaacgaaccaagcacgcaatccttagtgcctccgaagggcggatgagagtccggatccgctacgaggcatatctgacggggtctaccgccgtaaattacaatccccggcacaatggacatcatttctggggtttggggatcgctggagtgatgaggagcggcaacatcagcaacacgagaactatcacgggatcccaccatcaccatcaccatcaccat

SEQ ID NO: 112 - DNA, 777 bp, Huperzia phlegmaria
atgtctattcaaatcgacatcgagcctggcagcgtgcgggtgagtggaagttctcggcatatcattaccgatgccgatgtgagaactttcggcctcaatgacaacgccctcaagaatgctgtgctggcacactttggtagaaggcccaatgacgccttcctcagaagccccacgccttggggtgatctctataccacttacggttggccgcaggtccagacagtgcttgcggttcggagctcccaaattcttgaggagtcctccagaccggtgatgcttgcttaccagaatttcgtcaacaataccaacacggaagcaacttatacagctagcatgtctcgtgcggtgacaaattcgtcgtctaacacctggtccaatacgcactccttgacatttgaacaaaagatcaaatacggaatcaactttgggattaccgctgaaggagaaactacattgagctatgagttttcgtttggtcaaagcgggacagagtctgtcagtaccactttgagtacaggggcaggagttagtgtggttgttgccccgcatcgaaccaagcacgcaatccttagcgcctccgaagggcggatgagagtccggatccgctatgaggcatatttgacggggtctacccccgtgaattacaatccccggcacgatggacatcatttctggggcttggggatcgctggagtgatgaggagcggcaacatcagcaacacgagaactatcacgggatcccaccatcaccatcaccatcaccatcaccatcaccat

SEQ ID NO: 113 - DNA, 765 bp, Huperzia phlegmaria
atgtctattcaaatcgacatcgagcctggcagcgtgcgggtgagtggaagttctcggcatatcattaccgatgccgatgtgagaactttcggcctcaatgacaacgccctcaagaatgctgtgctggcacactttggtagaaggcccaatgacgccttcctcagaagccccacgccttggggtgatctctataccacttacggttggccgcaggtccagacagtgcttgcggttcggagctcccaaattcttgaggagtcctccagaccggtgatgcttgcttaccagaatttcgtcaacaataccaacacggaagcaacttatacagctagcatgtctcgtgcggtgacaaattcgtcgtctaacacctggtccaatacgcactccttgacatttgaacaaaagatcaaatacggaatcaactttgggattaccgctgaaggagaaactacattgagctatgagttttcgtttggtcaaagcgggacagagtctgtcagtaccactttgagtacaggggcaggagttagtgtggttgttgccccgcatcgaaccaagcacgcaatccttagcgcctccgaagggcggatgagagtccggatccgctatgaggcatatttgacggggtctaccgccgtgaattacaatccccggcacaatggacatcatttctggggcttggggatcgctggagtgatgaggagcggcaacatcagcaacacgagaactatcacgggatcccaccatcaccatcaccatcaccat

SEQ ID NO: 114 - DNA, 906 bp, Phlegmariurus nummularifolius
atggcttttgtaatcgacatcgagcctggcaacgtgcgggtgagtggaagttctcagcatattattaccgatgccgatgtgagaacttttggcctcaatgacaacgccctaaagaatgccgtgcaagcacacttcgaaagaaggcccaatgacgcctttctcagaagccccacgccttggggtgatctctataccagttacggttggcctcaggtccagacagtgcttgcagttcggagctcccaaattcttgaggagacctccagaccggtgatgcttgcttatcagactttcgtcaacaacaccaacacggaagcaacttatacagctaacatgtctcgtgtgatgagaaattcgtcgtctaacgcctggtccaatacacactccttatcgtttcaacaaaagatcaaatacggaatcaacttcgggattaccgctcaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcctgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 115 - DNA, 900 bp, Phlegmariurus nummularifolius
atgtctattcaaatcgacatcgagcctggcaacgtgcaggtgagtggaagttctcggcatattattaccgatgccgatgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcggttcggagctcccaaattcttgaggagacctccagaccggtgatgcttgattatcagaatttcgtcaacaacaccaatacggaagcaacttatccagctaacatgtctcgtgcggtgacaacttcgttgtctaacacctggtccaatacacactccttagcatttgaacaaaagatcaaatacggaatcaacttcgggattaccgctcaaggaggaactacattgagctataagttttcgtttggtcaaagctggacagagtcggtgagcatcacgatatcggcagtagcgagtgtggtagttggcccgcatcaaaccaagcacgcaatccttagcgctttggaagggcggatgagagtccggatccgctatgaagcatatctgacggggtctaccgccgtaaattacaatccccggcacagaggacatcacttctggggtttgggaatcgatggagtgatgaggagcggcaacatcagcaacacgagaactatcactgaggacatctcattgcactcctattccaacggcagcgttgtgtttggggagggaccagcgccactttcattggtagaagaagtaaaaacgttgaacgagaaggcgacgacgccaattccagtgatagaatcaacagaaccattggaggaggaggaagaagagaagaaggaa

SEQ ID NO: 116 - DNA, 906 bp, Phlegmariurus nummularifolius
atggcttttgtaatcaacatcgagcctggcaacgtgcgggtgagtggaagttctcagcatattattaccgatgccgatgtgagaacttttggcctcaatgacaacgccctaaagaatgccgtgcaagcacacttcgaaagaaggcccaatgacgcctttctcagaagccccacgccttggggtgatctctataccagttacggttggcctcaggtccagacagtgcttgcagttcggagctcccaaattcttgaggagacctccagaccggtgatgcttgcttatcagactttcgtcaacaacaccaacacggaagcaacttatacagctaacatgtctcgtgtgatgagaaattcgtcgtctaacgcctggtccaatacacactccttatcgtttcaacaaaagatcaaatacggaatcaacttcgggattaccgctcaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcctgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 117 - DNA, 906 bp, Phlegmariurus nummularifolius
atggcttttctaatcgacatcgagcctggcaacgtgcgggtgagtggaagttctcagcatattattaccgatgccgatgtgagaacttttggcctcaatgacaacgccctaaagaatgccgtgcaagcacacttcgaaagaaggcccaatgacgcctttctcagaagccccacgccttggggtgatctctataccagttacggttggcctcaggtccagacagtgcttgcagttcggagctcccaaattcttgaggagacctccagaccggtgatgcttgcttatcagactttcgtcaacaacaccaacacggaagcaacttatacagctaacatgtctcgtgtgatgagaaattcgtcgtctaacgcctggtccaatacacactccttatcgtttcaacaaaagatcaaatacggaatcaacttcgggattaccgctcaaggagaaactacattgagctatcagttttcgtttggtcaaagtgggacagagtcggtgagcaccacgatcagtacaggggcaggagtgagtgtggtagttgccccgcaccgaaccaagcacgcaatccttagcgcttcggaagggcggatgagagtccggatccgctatgaagcatatctgacggggtctaccgccgtaaattacaatccccggcacagaggacatcacttctggggtttggggatcgctggagtgatgaggagcggcaacatcagcaacaccagaactatcactgaggacatctcattgcagtcctattccaacggccgcgtcctgcttgaggagggaccagcgccaatttcattggtagaagaagtaacaacgttgaacgagaaggcgacggcgccaattccagtgatagagtcaacagaaccattggaggaggaggaagaagagaagaaggaa

SEQ ID NO: 118 - DNA, 900 bp, Phlegmariurus nummularifolius
atgtctattcaaatcgacatcgagcctggcaacgtgcgggtgagtggaagttctcggcatattattaccgatgccgatgtgagaactttcggcctcaatgacaacgccctaaagaatgccgtgctagcacacttcgaaagaaggcccaatgacgccttcctcagaagccccatgccttggggtgatctctataccacttacggttggcctcaggtccagacagtgcttgcggttcggagctcccaaattcttgaggagacctccagaccggtgatgcttgattatcagaatttcgtcaacaacaccaacacggaagcaacttatccagctaacatgtctcgtgcggtgacaacttcgttgtctaacacctggtccaatacacactccttagcatttgaacaaaagatcaaatacggaatcagcttcgggattaccgctcaaggaggaactacattgagctataagttttcgtttggtcaaagctggacagagtcggtgagcatcacgatatcggcagtagcgagtgtggtagttggcccgcaccaaaccaagcacgcaatccttagtgctttggaagggcagatgagagtccggatccgctatgaagcatatctgacggggtctaccgccgtaaattacaatccccgacacagaggacatcacttctggggtttgggaatcgatggagtgatgaggagcggcaacatcagcaacacgagaactattactgaggacatctcattgcactcctattccaacggcagcgtcgtgtttggggagggaccagcgccactttcattggtagaagaagtaaaaacgttgaacgagaaggcgacgacgccaattccagtgatagaatcaacagaaccattggaggaggaggaagaagagaagaaggaa

SEQ ID NO: 119 - DNA, 885 bp, Huperzia phlegmaria
atgtctattgaaatcgacattgagcctggcagagtgcgggtgagtggaagttctcggcatatcattactgatgcggacgtgggaacttttggcctccatgacaacgccctcaagaatgccgtcttggcacacttcggcagaaggcccaatgacgccttcctcagaagccccacaccttggaatgatctctacacctcttacggttgggcgcaggtccaaacagtacttgtggttcggagctcaacaattcttgaggagtcctccagaccggcgatgcttgcctaccagaatttcatcaacaataccagcacggaagcaacttatacagctgaaatgtcccgtgcgatgaccaactcgtcgtctaacacctggtccaatacgcacaacatcaggtttgaacagacgatcacttacaaaatcaacttcgggattaccgctggcggagaaacttcgatgggctatgagttttcgtttggtcaaagcgggacaactgagacgagcaccactattagttcaggagcagcagtgagtgtggtagttgggccgcacagaaccaagcacgcaatccttagcgcctcggaagggcggatgagagtccggataacttatgaggtttatctcactgggtctaccgccgtgaattacaatcctcggcataatggacatcacttctggggtttggggatcgctggggtgatgaggagcggcaacatcagcagcacgaggactatcactgaggacatcacgttgcagtcctattccaacggcagcatcgtgcttggggagggaccggcgccaagtccagtggtagaagaagtagaaacgttggagaaggagaaggaaaaaaaaggatcccaccatcaccatcaccatcaccatcaccat

SEQ ID NO: 120 - DNA, 885 bp, Huperzia phlegmaria
atgtctattgaaatcgacattgagcctggcagagtgtgggtgagtggaagttctcggcatatcattactgatgcggacgtgggaacttttggcctccatgacaacgccctcaagaatgccgtcctggcacacttcggcagaaggcccaatgacgccttcctcagaagccccacaccttggaatgatctctacacctcttacggttgggcgcaggtccaaacagtacttgtggttcggagctcaacaattcttgaggagtcctccagaccggcgatgcttgcctaccagaatttcatcaacaataccagcacggaagcaacttatacagctgaaatgtcccgtgcgatgaccaactcgtcgtctaacacctggtccaatacgcacaacatcaggtttgaacagacgatcacttacaaaatcaacttcgggattaccgctggcggagaaacttcgatgggctatgagttttcgtttggtcaaagcgggacaactgagacgagcaccactattagttcaggagcagcagtgagtgtggtagttgggccgcacagaactaagcacgcaatccttagcgcctcggaagggcggatgagagtccggataacttatgaggtttatctcactgggtctaccgccgtgaattacaatcctcggcataatggacatcacttctggggtttggggattgctggggtgatgaggagcggcaacatcagcagcacgaggactatcactgaggacatcacgttgcagtcctattccaacggcagcatcgtgcttggggagggaccggcgccaagtccagtggtagaagaagtagaaacgttggagaaggagaaggagaagaaaggatcccaccatcaccatcaccatcaccatcaccat

SEQ ID NO: 121 - DNA, 891 bp, Huperzia phlegmaria
atgtctattgaaatcgacattgagcctggcagagtgcgggtgagtggaagttctcggcatatcattactgatgcggacgtgggaacttttggcctccatgacaacgccctcaaaaatgccgtcctggcacacttcggcagaaggcccaatgacgccttcctcagaagccccacaccttggaatgatctctacacctcttacggttgggcgcaggtccaaacagtacttgtggttcggagctcaacaattcttgaggagtcctccagaccggcgatgcttgcctaccagaatttcatcaacaataccagcacggaagcaacttatacagctgaaatgtcccgtgcgatgaccaactcgtcgtctaacacctggtccaatacgcacaacatcaggtttgaacagacgatcacttacaaaatcaacttcgggattaccgctggcggagaaacttcgatgggctatgagttttcgtttggtcaaagcgggacaaatgagacgagcaccactattagttcaggagcagcagtgagtgtggtagttgggccgcacagaaccaagcacgcaatccttagcgcctcggaagggcggatgagagtccggatcacttatgaggtgtatctcactgggtctaccgccgtgaattacaatcctcggcataatggacatcacttctggggtttggggatcgctggggtgatgaggagcggcaacatcagcagcacgaggactatcactgaggacatcacgttgcagtcctattccaacggcagcatcgtgcttggggagggaccggcgccaagtccagtggtagaagaagtagaaaagttggagaaggagaaggagaaaaaaggatcccaccatcaccatcaccatcaccatcaccatcaccat

SEQ ID NO: 122 - DNA, 885 bp, Huperzia phlegmaria
atgtctattgaaatcgacattgagcctggcagagtgcgggtgagtggaagttctcggcatatcattactgatgcggacgtgggaacttttggcctccatgacaacgccctcaagaatgccgtcctggcacacttcggcagaaggcccaatgacgccttcctcagaagccccacaccttggaatgatctctacacctcttacggttgggcgcaggtccaaacagtacttgtggttcggagctcaacaattcttgaggagtcctccagaccggcgatgcttgcctaccagaatttcatcaacaataccagcacggaagcaacttatacagctgaaatgtcccgtgcgatgaccaactcgtcgtctaacacctggtccaatacgcacaacatcaggtttgaacagacgatcacttacaaaatcaacttcgggattaccgctggcggagaaacttcgatgggctatgagttttcgtttggtcaaagcgggacaactgagacgagcaccactattagttcaggagcagcagtgagtgtggtagttgggccgcacagaactaagcacgcaatccttagcgcctcggaagggcggatgagagtccggataacttatgaggtttatctcactgggtctaccgccgtgaattacaatcctcggcataatggacatcacttctggggtttggggattgctggggtgatgaggagcggcaacatcagcagcacgaggactatcactgaggacatcacgttgcagtcctattccaacggcagcatcgtgcttggggagggaccggcgccaagtccaggggtagaagaaatagaaacgttggagaaagagaaagagaagaaaggatcccaccatcaccatcaccatcaccatcaccat

SEQ ID NO: 123 - DNA, 879 bp, Huperzia phlegmaria
atgtctattgaaatcgacattgagcctggcagagtgcgggtgagtggaagttctcggcatatcattactgatgcggacgtgggaacttttggcctccatgacaacgccctcaagaatgccgtcctggcacacttcggcagaaggcccaatgacgccttcctcagaagccccacaccttggaatgatctctacacctcttacggttgggcgcaggtccaaacagtacttgtggttcggagctccacaattcttgaggagtcctccagaccggcgatgcttgcctaccagaatttcatcaataataccagcacggaagcaacttatacagctgaaatgtcccgtgcgatgaccaactcgtcgtctaacacctggtccaatacgcacaacatcaggtttgaacagacgatcacttacaaaatcaacttcgggattaccgctggcggagaaacttcgatgggctatgagttttcgtttggtcaaagcgggacaaatgagacgagcaccactattagttcaggagcagcagtgagtgtggtagttgggccgcacagaaccaagcacgcaatccttagcgcctcggaagggcggatgagagtccggatcacttatgaggtgtatctcactgggtctaccgccgtgaattacaatcctcggcataatggacatcacttctggggtttggggatcgctggggtgatgaggagcggcaacatcagcagcacgaggactatcactgaggacatcacgttgcagtcctattccaacggcagcatcgtgcttggggagggaccggcgccaagtccagtggtagaagaagtagaaaagttggagaaggagaaggagaagaaaggatcccaccatcaccatcaccatcaccat

SEQ ID NO: 124 - DNA, 897 bp, Huperzia carinata
atgtcaattgaaatcgacattgagcctggcagcgtgcgggtgagtggaagttctcggcatatcattaccgatgccgacgtgggaactttcggcctccatgacaacgctctcaagaatgccgtgctagcacacaatggcagaaggcccaatgacgccttcctcagaagccccacaccttggaatgatctctacaccacttacggttgggcgcaggtccaaacagtacttgtggttcggagctccacaattcttgaggagtcctccagaccgacgtcgcttgcttaccagaacttcgtcaacaataccagcagcgaagcaacttatacagctcacttgtcccgtgagatgaccaattcgtcgtctaacacctggtccaatacgcacagcatcagatttgaacagacgatcacttacaaaatcaacttcgggattaccgctggcggagaaacttcgtttggctatgagtcttcgtttggtcaaagcgggacacatgagacgagcaccactattagttcaggagcatcagtgagtgtggtagttggcccgcacagaaccaagcacgcaatccttagcgcctctgaagggcggatgagagtccggatcacgtatgaggtgtatctcacggggtctacggccgtgaattacaatcctcggcataatggacatcacttctggggtttggggatctctggagtgatgaggagcggcaacatcagcaacacgaggactatcactgaggacgtcacgttgcagtcgtattccaacggcagcatcgtgcttggggagggaccggcgccaagtgcagtggtagaagcggtagaaacgctggagaaggagcaagagaaggagaaggagaaggagaagaaaggatcccaccatcaccatcaccatcaccat

SEQ ID NO: 125 - DNA, 897 bp, Huperzia carinata
atgtcaattgaaatcgacattgagcctggcagtgtgcgggtgagtggaagttctcggcatatcattaccgatgctgacgtgggaactttcggcctccatgacgatgctctcaagaatgccgtgctagcacacaatggcagaaggcccaatgacgccttcctcagaagccccacatcttggaatgatctctacaccacttacggctgggcgcaggtccaaacagtacttgtggttcggagctccacaattcttgagcagtcctccagaccgacggcgcttgcttaccagaacttcatcaacaataccagcaccgaagcaacttatacagctcaattgtcccgtgagatgaccaattcgtcgtctaacacctggtccaatacgcacagcatcagatttgaacagacgataacttacaaaattaacttcgggattaccgctggcggagaaacttcgttgggctatgagtcttcgtttggtcaaagcgggacacatgagacgagcaccactattagttcaggagcatcagtgagtgtggtagttggcccgcacagaaccaagcacgcaatccttagcgcctctgaagggcggatgagagtccggatcacgtatgaggtgtatctcacggggtctaccgccgtgaattacaatcctcggcataatggacatcacttctggggtttggggatctctggagtgatgaggagcggcaacatcagcaacacgaggactatcactgaggacgtcacgttgcagtcctattccaacggcagcatcgtgcttggggaaggaccggcgccaagtccagtggtggaagctgtagaaacgctggagaaggagaaagagaaggaaaaggagaagaaaggatcccaccatcaccatcaccatcaccatcaccat

SEQ ID NO: 126 - DNA, 897 bp, Huperzia carinata
atgtcaattgaaatcgacattgagcctggcagcgtgcgggtgagtggaagttctcggcatatcattaccgatgccgacgtgggaactttcggcctccatgacaacgctctcaagaatgccgtgctagcacacaatggcagaaggcccaatgacgccttcctcagaagccccacaccttggaatgatctctacaccacttacggttgggcgcaggtccaaacagtacttgtggttcggagctccacaattcttgaggagtcctccagaccgacgtcgcttgcttaccagaacttcgtcaacaataccagcagcgaagcaacttatacagctcacttgtcccgtgagatgaccaattcgtcgtctaacacctggtccaatacgcacagcatcagatttgaacagacgatcacttacaaaatcaacttcgggattaccgctggcggagaaacttcgtttggctatgagtcttcgtttggtcaaagcgggacacatgagacgagcaccactattagttcaggagcatcagtgagtgtggtagttggcccgcacagaaccaagcacgcaatccttagcgcctctgaagggcggatgagagtccggatcacgtatgaggtgtatctcacggggtctacggccgtgaattacaatcctcggcataatggacatcacttctggggtttggggatctctggagtgatgaggagcggcaacatcagcaacacgaggactatcactgaggacgtcacgttgcagtcgtattccaacggcagcatcgtgcttggggagggaccggcgccaagtgcagtggtagaagcggtagaaacgctggagaaggagcaagagaaggagaaggagaagaaaggatcccaccatcaccatcaccatcaccatcaccat

SEQ ID NO: 127 - DNA, 915 bp, Huperzia carinata
atgtcaattgaaatcgacattgagcctggcagcgtgcgggtgagtggaagttctcggcatatcattaccgatgccgacgtgggaactttcggcctccatgacaacgctctcaagaatgccgtgctagcacacaatggcagaaggcccaatgacgccttcctcagaagccccacaccttggaatgatctctacaccacttacggttgggcgcaggtccaaacagtacttgtggttcggagctccacaattcttgaggagtcctccagaccgacgtcgcttgcttaccagaacttcgtcaacaataccagcagcgaagcaacttatacagctcacttgtcccgtgagatgaccaattcgtcgtctaacacctggtccaatacgcacagcatcagatttgaacagacgatcacttacaaaatcaacttcgggattaccgctggcggagaaacttcgtttggctatgagtcttcgtttggtcaaagcgggacacatgagacgagcaccactattagttcaggagcatcagtgagtgtggtagttggcccgcacagaaccaagcacgcaatccttagcgcctctgaagggcggatgagagtccggatcacgtatgaggtgtatctcacggggtctacggccgtgaattacaatcctcggcataatggacatcacttctggggtttggggatctctggagtgatgaggagcggcaacatcagcaacacgaggactatcactgaggacgtcacgttgcagtcgtattccaacggcagcatcgtgcttggggagggaccggcgccaagtgcagtggtagaagcggtagaaacgctggagaaggagcaagagaaggagaaggagaaggaaaaagagaaggagaagaaaggatcccaccatcaccatcaccatcaccatcaccat

SEQ ID NO: 128 - DNA, 906 bp, Huperzia carinata
atgtcaattgaaatcgacattgagcctggcagcgtgcgggtgagtggaagttctcggcatatcattaccgatgccgacgtgggaactttcggcctccatgacaacgctctcaagaatgccgtgctagcacacaatggcagaaggcccaatgacgccttcctcagaagccccacaccttggaatgatctctacaccacttacggttgggcgcaggtccaaacagtacttgtggttcggagctccacaatccttgagcagtcctccagaccgactgcgcttgcttaccagaacttcatcaacaataccagcaccgaagcaacttatacagctcaattgtcccgtgagatgaccaattcgtcgtctaacacctggtccaatacgcacagcatcagatttgaacagacgatcacttacaaaatcaacttcgggattaccgctggcggagaaacttcgttgggctatgagtcttcgtttggtcaaagcgggacacatgagacgagcaccactattagttcaggagcctcagtgagtgtggtagttggcccgcacagaaccaagcacgcaatccttagcgcctctgaagggcggatgcgagtccggatcacgtatgaggtgtatctcacggggtctaccgccgtgaattacaatcctcggcataatggacatcacttctggggtttggggatctctggagtgatgaggagcggcaacatcagcaacacgaggactatcactgaggacgtcacgttgcagtcgtattccaacggcagcatcgtgcttggggagggaccggcgccaagtgcagtggtagaagcggtagaaacgctggagaaggagaaagagagggagagggagaagaaaggatcccaccatcaccatcaccatcaccatcaccattaatctaga

SEQ ID NO: 129 - DNA, 825 bp, Huperzia goebelii
atggcttttgtggtccaagtcaagcacggaagagtgaatgccactggaaattctgagcatgtcattacggatgccgatgtgagatccttcggcatccatgacagcgccctcaaggatgccgtcacaaaacacttcggtagatggcccactgacgcctacctcaaaagccccacgccttggaatgacctctacaaaacttacggttggccgcaggttcagaccgtgcttaaggtccagagctcctcgattactgaggcaacctccaaaccagtgatagttgcttaccagaattttgttaataattccaatgaagaagccacttatacagctaacatgtctcgccagaagaccaattcggcttcccatacctggtccaaccagcacacgttaaagattgagcagaagatcaaatacgaaatcaacttcggggttaatgttgggggagaaactaccctgtcctatcagtatgcatttggcgagagtgggacaaaaaccgtgagcaccactatctcttcagggtcagcagtgactgtgaaggtaggcccgcatcaaaccaagcatgcaatccttcgcgcctccgaaggccagatgaaagtccgcatcgtttacgaggctcatctgaaggggtctactgccgtgaattacaatcccacgtacaaggggcatcacttctacggtttggatatcgccgccgtcatgagcgcaggaggcattagcagcaggaagactataacagaagacgttgtgctggactacttcgcgcagtccagtgtggtggttggggatggaccagcgccatcgtcagtgttagcagcagtagccaaa

SEQ ID NO: 130 - DNA, 825 bp, Huperzia goebelii
atggcttttgtggtccaagtcaagaacggaagagtgaatgccactggaaattctgagcatgtcattacggatgccgatgtgagatccttcggcatccatgacagcgccctcaaggatgccgtcacaaaacacttcggtagatggcccactgacgcctacctcaaaagccccacgccttggaatgacctctacaaaacttacggttggccgcaggttcagaccgtgcttaaggtccagagctcctcgattactgaggcaacctccaaaccagtgatagttgcttaccagaattttgttaataattccaatgaagaagccacttatacagctaacatgtctcgccagaagaccaattcggcttcccatacctggtccaaccagcacacgttaaagattgagcagaagatcaaatacgaaatcaacttcggggttaatgttgggggagaaagtaccctgtcctatcagtatgcatttggcgagagtgggacaaaaaccgtgagcaccactatctcttcagggtcagcagtgactgtgaaggtaggcccgcatcaaaccaagcatgcaatccttcgcgcctccgaaggccagatgaaagtccgcatcgtttacgaggctcatctgaaggggtctactgccgtgaattacaatcccacgtacaaggggcatcacttctacggtttggatatcgccgccgtcatgagcgcaggaggcattagcagcaggaagactataacagaagacgttgtgctggactacttcgcgcagtccagtgtggtggttggggatggaccagcgccatcgtcagtgttagcagcagtagccaaa

SEQ ID NO: 131 - DNA, 825 bp, Huperzia goebelii
atggcttttgtggtccaagtcaagaacggaagagtgaatgccactggaaattctgagcatgtcattacggatgccgatgtgagatccttcggcatccatgacagcgccctcaaggatgccgtcacaaaacacttcggtagatggcccactgacgcctacctcaaaagccccacgccttggaatgacctctacaaaacttacggttggccgcaggttcagaccgtgcttaatgtccagagctcctcgattactgaggcaacctccaaaccagtgatagttgcttaccagaattttgttaataattccaatgaagaatccacttatacagctaacatgtctcgccagaagaccaattcggcttcccatacctggtccaaccagcacacgttaaagattgagcagaagatcaaatacgaaatcaacttcggggttaatgttgggggagaaactaccctgtcctatcagtatgcatttggcgagagtgggacaaaaaccgtgagcaccactatctcttcagggtcagcagtgactgtgaaggtaggcccgcatcaaaccaagcatgcaatccttcgcgcctccgaaggccagatgaaagtccgcatcgtttacgaggctcatctgaaggggtctactgccgtgaattacaatcccacgtacaaggggcatcacttctacggtttggatatcgccgccgtcatgagcgcaggaggcattagcagcaggaagactataacagaagacgttgtgctggactacttcgcgcagtccagtgtggtggttggggatggaccagcgccatcgtcagtgttagcagcagtagccaaa

SEQ ID NO: 132 - DNA, 825 bp, Huperzia goebelii
atggcttttgtggtccaagtcaagaacggaagagtgaatgccactggaaattctgagcatgtcattacggatgccgatgtgagatccttcggcatccatgacagcgccctcaaggatgccgtcacaaaacacttcggtagatggcccactgacgcctacctcaaaagccccacgccttggaatgacctctacaaaacttacggttggccgcaggttcagaccgtgcttaaggtccagagctcctcgattactgaggcaacctccaaaccagtgatagttgcttaccagaattttgttaataattccaatgaagaagccacttatacagctaacatgtctcgccagaagaccaattcggcttcccatacctggtccaaccagcacacgttaaagattgagcagaagatcaaatacgaaatcaacttcggggttaatgttgggggagaaagtaccctgtcctatcagtatgcatttggcgagagtgggacaaaaaccgtgagcaccactatctcttcagggtcagcagtgactgtgaaggcaggcccgcatcaaaccaagcatgcaatccttcgcgcctccgaaggccagatgaaagtccgcatcgtttacgaggctcatctgaaggggtctactgccgtgaattacaatcccacgtacaaggggcatcacttctacggtttggatatcgccgccgtcatgagcgcaggaggcattagcagcaggaagactataacagaagacgttgtgctggactacttcgcgcagtccagtgtggtggttggggatggaccagcgccatcgtcagtgttagcagcagtagccaaa

SEQ ID NO: 133 - DNA, 825 bp, Huperzia goebelii
atggcttttgtggtccaagtcaagaacggaagagtgaatgccactggaaattctgagcatgtcattacggatgccgatgtgaaatccttcggcatccatgacagcgccctcaaggatgccgtcacaaaacacttcggtagatggcccactgacgcctacctcaaaagccccacgccttggaatgacctctacaaaacttacggttggccgcaggttcagaccgtgcttaatgtccagagctcctcgattactgaggcaacctccaaaccagtgatagttgcttaccagaattttgttaataattccaatgaagaatccacttatacagctaacatgtctcgccagaagaccaattcggcttcccatacctggtccaaccagcacacgttaaagattgagcagaagatcaaatacgaaatcaacttcggggttaatgttgggggagaaactaccctgtcctatcagtatgcatttggcgagagtgggacaaaaaccgtgagcaccactatctcttcagggtcagcagtgactgtgaaggtaggcccgcatcaaaccaagcatgcaatccttcgcgcctccgaaggccagatgaaagtccgcatcgtttacgaggctcatctgaaggggtctactgccgtgaattacaatcccacgtacaaggggcatcacttctacggtttggatatcgccgccgtcatgagcgcaggaggcattagcagcaggaagactataacagaagacgttgtgctggactacttcgcgcagtccagtgtggtggttggggatggaccagcgccatcgtcagtgttagcagcagtagccaaa

SEQ ID NO: 134 - DNA, 825 bp, Huperzia goebelii
atggcttttgtgatcgccatcaagcccggaaatgtgaatgccactggaaattctcagcatgtcatcacagatgccgatgtgaaatccttcggcatccatgacagcgccctcaaggatgccgtcacaaaacacttcggtagatggcccactgacgcctacctcaaaagccccacgccttggaatgacctctacaaaacttacggttggccgcaggttcagaccgtgcttaatgtccagagctcctcgattactgaggcaacctccaaaccagtgatagttgcttaccagaattttgttaataattccaatgaagaatccacttatacagctaatatgtctcgccagaagaccgattcggcttcccacacctggtccagccagcacaccttgaaggttgatcaaaagataaaatacgagatcaacttcggagttaatgttgggggagaaactaccctgtcctatcagtatgcatttggggagagtgggacaaaaaccacgaccaccactctgtcttcagggtcaggagtgaaagtgaacgtaggcccgcatcgaaccaagcacgcaatccttcgcgcctcgcaaggccaaatgaaagtccgcattgtttacgttgctcatctgaccgggtctattgctgtgaattacgatcccacgtacaaggggcatcacttctacagcttggatatcggtgttgtcatgagcaaaggaggcatcagcagcagcaagactataacagaagacattgtgctggactactactcgcattccactgtggaggttggggatgggccagcgccatcgtcagtagtattagctgtagcgaaa

SEQ ID NO: 135 - DNA, 825 bp, Huperzia goebelii
atggcttttgtggtccaagtcaagaacggaagagtgaatgccactggaaattctgagcatgtcattacggatgccgatgtgaaatccttcggcatccatgacagcgccctcaaggatgccgtcacaaaacacttcggtagatggcccactgacgcctacctcaaaagccccacgccttggaatgacctctacaaaacttacggttggccgcaggttcagaccgtgcttaaggtccagagctcctcgattactgaggcaacctccaaaccagtgatagttgcttaccagaattttgttaataattccaatgaagaagccacttatacagctaacatgtctcgccagaagaccaattcggcttcccatacctggtccaaccagcacacgttaaagattgagcagaagatcaaatacgaaatcaacttcggggttaatgttgggggagaaagtaccctgtcctatcagtatgcatttggcgagagtgggacaaaaaccgtgagcaccactatctcttcagggtcagcagtgactgtgaaggcaggcccgcatcaaaccaagcatgcaatccttcgcgcctccgaaggccagatgaaagtccgcatcgtttacgaggctcatctgaaggggtctactgccgtgaattacaatcccacgtacaaggggcatcacttctacggtttggatatcgccgccgtcatgagcgcaggaggcattagcagcaggaagactataacagaagacgttgtgctggactacttcgcgcagtccagtgtggtggttggggatggaccagcgccatcgtcagtgttagcagcagtagccaaa

SEQ ID NO: 136 - DNA, 825 bp, Huperzia goebelii
atggcttttgtggtccaagtcaagaacggaagagtgaatgccactggaaattctgagcatgtcattacggatgccgatgtgaaatccttcggcatccatgacagcgccctcaaggatgccgtcacaaaacacttcggtagatggcccactgacgcctacctcaaaagccccacgccttggaatgacctctacaaaacttacggttggccgcaggttcagaccgtgcttaatgtccagagctcctcgattactgaggcaacctccaaaccagtgatagttgcttaccagaattttgttaataattccaatgaagaatccacttatacagctaacatgtctcgccagaagaccaattcggcttcccatacctggtccaaccagcacacgttaaagattgagcagaagatcaaatacgaaatcaacttcggggttaatgttgggggagaaagtaccctgtcctatcggtatgcatttggcgagagtgggacaaaaaccgtgagcaccactatctcttcagggtcagcagtgactgtgaaggtaggcccgcatcaaaccaagcatgcaatccttcgcgcctccgaaggccagatgaaagtccgcatcgtttacgaggctcatctgaaggggtctactgccgtgaattacaatcccacgtacaaggggcatcacttctacggtttggatatcgccgccgtcatgagcgcaggaggcattagcagcaggaagactataacagaagacgttgtgctggactacttcgcgcagtccagtgtggtggttggggatggaccagcgccatcgtcagtgttagcagcagtagccaaa

SEQ ID NO: 137 - DNA, 825 bp, Huperzia carinata
atggcttttgtgatcaaagtcaagcccggaaaagtgaatgccactggaaattctcggcacgtcattacggatgccgatgtgaactccttcggcatccatgacagcgccctcaaggatgccgtcacaaaatacttcggcagatggcccactgacgcctacctcaaaagccccacaccttggaatgacctctacaaaacttacggttggccgcaggttcagaccgtgcttaaggtccagagctcctcgattactgaggcatcttccaaactagtgatacttcagtaccaaaattttgttaacaagtccaatgaagatgccacttatacagcgaacatgtctcgccagaagaccaattcggcttcccatacctggtccaaccagcacaccttaaagattgagcagaagatcaaatacgaaatcaacttcggggttaatgttgggggagaaactaccctgtcctatcagtatgcatttggcgagagtgggacaaaaaccacgaccaccactctctcttcagggtcaggagtgactgtgaaggtaggcccgcataaaaccaagcatgcaatccttcgcgcctcggaaggccagatgaaagtccgcattgtttacgtggctaatctgacggggtctaccgctgtgaattactatcccacgtacaaggggcatcacttctacagcttggatatcgctggcgtcatgagcgcaggaggcatttgcagcagcaagactataacagaagacgttgtgctggactactactcgcattccactgtggaggttggggatggaccagcgccatcgtcagtgttagcagcagtagccgaa

SEQ ID NO: 138 - DNA, 825 bp, Huperzia carinata
atggcttttgtgatcaaagtcaagcccggaaaagtgaatgccagtggaaattctcagcacgtcattacggatgccgatgtgaaatccttcggcatccatgacagcgccctcaaggatgccgtcacaaaatacttcggcagatggcccactgacgcttacctcaaaagccccactccttggaatgacctttacaaaacttacggttggccgcaggttcagaccgtgcttaaggtccagagctcctcgattactgaggcaacctccaaaccagtgatacttgattaccagaattttgttaataagtccagtgaagaagccacttatacagctaacatgtctcgccagaagaccaattcggcttcccatacctggtccaatcagcacacctttaagattgatcagaagatcaaatacgaaatcaacttcggggctaatggtgggggagaaactaccctgtcctatcagtatgcatttggcgagagtgagacaaaaaccacgaccaccactctctcttcaggatcaggagtgactgtgaaggtaggcccgcataaaaccaagcatgcaatccttcgcgcctcggaaggccagatgaaagtccgcattgtttacgcggctcatctgacggggtctaccgctgtgaattactatcccacgtacaaggggcatcacttctacagcttggatatcgctggcgtcatgagcgcaggaggcatttgcagcagcaagactataacagaagacgttgtgctggactactactcgcattccacggtggaggttggggatggaccagcgccatcgtcagtgttagcagcagtagccgaa

SEQ ID NO: 139 - DNA, 861 bp, Huperzia phlegmaria
atggcttttgtgatcaaagtcaagcccggaaatgtgaatgccactggaaattctcagcacgtcattacggatgccgatgtgaaatccttcggcatccatgacagcgccctcaaggatgccgtcacaaaatacttcggcagatggcccactgacgcttacctcaaaagccccactccttggaatgacctctacaaaacttacggttggccacaggttcagatcgtgcttaaggtccagagctcctcgattaccgaggcatcctccaaaccagtgatacttcagtaccaaaattttattaacaagtccaatgaagaagccacttatacagcgaacatgtctcgccagaagaccaattcggcttcccatacctggtccaaccagcacaccttaaaggttgagcagaagatcaaatacgaaatcaacttcggggtcaatgttgggggagaaactaccctgtcctatcagtatgcatttggcgagagtgggacaaagaccacgaccaccactctctcttcagggtcaggagtgactgtgaaggtaggcccgcataaaaccaagcatgcaatccttcgcgcctcggaaggccagatgaaagtccgcattgtttacgtggctcatctgacggggtctaccgctgtgaattactatcccacgtacaaggggcatcacttctacagcttggatatcgctggagtcatgagcgcaggaggcattagcagcagcaagactataacagaagacgttgtgctggactactactcgcattccactgtggaggttggggatggaccagcgccatcgtcagtgtcagcagcagtagccaaaggatcccaccatcaccatcaccatcaccatcaccat

SEQ ID NO: 140 - DNA, 855 bp, Huperzia phlegmaria
atggcttttgtgatcaaagtcaagcccggaaatgtgaatgccactggaaattctcagcacgtcattacggatgccgatgtgaaatccttcggcatccatgacagcgccctcaaggatgccgtcacaaaatacttcggcagatggcccactgacgcttacctcaaaagccccactccttggaatgacctctacaaaacttacggttggccacaggttcagatcgtgcttaaggtccagagctcctcgattactgaggcatcctccaaaccagtgatacttcagtaccaaaattttattaacaagtccaatgaagaagccacttatacagcgaacatgtctcgccagaagaccaattcggcttcccatacctggtccaaccagcacaccttaaaggttgagcagaagatcaaatacgaaatcaacttcggggtcaatgttgggggagaaactaccctgtcctatcagtatgcatttggcgagagtgggagaaaaaccacgaccaccactctctcttcagggtcaggagtgactgcgaaggtaggcccgcataaaaccaagcatgcaatccttcgcgcctcggaaggccagatgaaagtccgcattgtttacgtggctcatctgacggggtctaccgctgtgaattactatcccacgtacaaggggcatcacttctacagcttggatatcgctggagtcatgagcgcaggaggcattagcagcagcaagactataacagaagacgttgtgctggactactactcgcattccactgtggaggttggggatggaccagcgccatcgtcagtgtcagcagcagtagccaaaggatcccaccatcaccatcaccatcaccat

SEQ ID NO: 141 - DNA, 861 bp, Huperzia phlegmaria
atggcttttgtgatcaaagtcaagcccggaaatgtgaatgccactggaaattctcagcacgtcattacggatgccgatgtgaaatccttcggcatccatgacagcgccctcaaggatgccgtcacaaaatacttcggcagatggcccactgacgcttacctcaaaagccccactccttggaatgacctctacaaaacttacggttggccacaggttcagatcgtgcttaaggtccagagctcctcgattactgaggcatcctccaaaccagtgatacttcagtaccaaaattttattaacaagtccaatgaagaagccacttatacagcgaacatgtctcgccagaagaccaattcggcttcccatacctggtccaaccagcacaccttaaaggttgagcagaagatcaaatacgaaatcaacttcggggtcaatgttgggggagaaactaccctgtcctatcagtatgcatttggcgagagtgggagaaaaaccacgaccaccactctctcttcagggtcaggagtgactgtgaaggtaggcccgcataaaaccaagcatgcaatccttcgcgcctcggaaggccagatgaaagtccgcattgtttacgtggctcatctgacggggtctaccgctgtgaattactatcccacgtacaaggggcatcacttctacagcttggatatcgctggagtcatgagcgcaggaggcattagcagcagcaagactataacagaagacgttgtgctggactactactcgcattccactgtggaggttggggatggaccagcgccatcgtcagtgtcagcagcagtagccaaaggatcccaccatcaccatcaccatcaccatcaccat

SEQ ID NO: 142 - DNA, 861 bp, Huperzia phlegmaria
atggcttttgtgatcaaagtcaagcccggaaatgtgaatgccactggaaattctcagcacgtcattacggatgccgatgtgaaatccttcggcatccatgacagcgccctcaagggtgccgtcacaaaatacttcggcagatggcccactgacgcttacctcaaaagccccactccttggaatgacctctacagaacttacggttggccacaggttcagatcgtgcttaaggtccagagctcctcgattaccgaggcatcctccaaaccagtgatacttcagtaccaaaattttattaacaagtccaatgaagaagccacttatacagcgaacatgtctcgccagaagaacaattcggcttcccatacctggtccaaccagcacaccttaaaggttgagcagaagatcaaatacgaaatcaacttcggggtcaatgttgggggagaaactaccctgtcctatcagtatgcatttggcgagagtgggacaaaaaccacgaccaccactctctcttcagggtcaggagtgactgtgaaggtaggcccgcataaaaccaagcatgcaatccttcgcgcctcggaaggccagatgaaagtccgcattgtttacgtggctcatctgacggggtctaccgctgtgaattactatcccacgtacaaggggcatcacttctacagcttggatatcgctggagtcatgagcgcaggaggcattagcagcagcaagactataacagaagacgttgtgctggactactactcgcattccactgtggaggttggggatggaccagcgccatcgtcagtgtcagcagcagtagccaaaggatcccaccatcaccatcaccatcaccatcaccat

SEQ ID NO: 143 - DNA, 861 bp, Huperzia phlegmaria
atggcttttgtgatcaaagtcaagcccggaaatgtgaatgccactggaaattctcagcacgtcattacggatgccgatgtgaaatccttcggcatccatgacagcgccctcaaggatgccgtcacaaaatacttcggcagatggcccactgacgcttacctcaaaagccccactccttggaatgacctctacaaaacttacggttggccacaggttcagatcgtgcttaaggtccagggctcctcgattaccgaggcatcctccaaaccagtgatacttcagtaccaaaattttattaacaagtccaatgaagaagccacttatacagcgaacatgtctcgccagaagaacaattcggcttcccatacctggtccaaccagcacaccttaaaggttgagcagaagatcaaatacgaaatcaacttcggggtcaatgttgggggagaaactaccctgtcctatcagtatgcatttggcgagagtgggacaaaaaccacgaccaccactctctcttcagggtcaggagtgaccgtgaaggtaggcccgcataaaaccaagcatgcaatccttcgcgcctcggaaggccagatgaaagtccgcattgtttacgtggctcatctgacggggtctaccgctgtgaattactatcccacgtacaaggggcatcacttctacagcttggatatcgctggagtcatgagcgcaggaggcattagcagcagcaagactataacagaagacgttgtgctggactactactcgcattccactgtggaggttggggatggaccagcgccatcgtcagtgtcagcagcagtagccaaaggatcccaccatcaccatcaccatcaccatcaccat

SEQ ID NO: 144 - DNA, 861 bp, Huperzia phlegmaria
atggcttttgtgatcaaagtcaagcccggaaatgtgaatgccactggaaattctcagcacgtcattacggatgccgatgtgaaatccttcggcatccatgacagcgccctcaaggatgccgtcacaaaatacttcggcagatggcccactgacgcttacctcaaaagccccactccttggaatgacctctacaaaacttacggttggccacaggttcagatcgtgcttaaggtccagagctcctcgattaccgaggcatcctccaaaccagtgatacttcagtaccaaaattttattaacaagtccaatgaagaagccacttatacagcgaacatgtctcgccagaagaacaattcggcttcccatacctggtccaaccagcacaccttaaaggttgagcagaagatcaaatacgaaatcaacttcggggtcaatgttgggggagaaactaccctgtcctatcagtatgcatttggcgagagtgggacaaaaaccacgaccaccactctctcttcagggtcaggagtgactgtgaaggtaggcccgcataaaaccaagcatgcaatccttcgcgcctcggaaggccagatgaaagtccgcattgtttacgtggctcatctgacggggtctaccgctgtgaattactatcccacgtacaaggggcatcacttctacagcttggatatcgctggagtcatgagcgcaggaggcattagcagcagcaagactataacagaagacgttgtgctggactactactcgcattccactgtggaggttggggatggaccagcgccatcgtcagtgtcagcagcagtagccaaaggatcccaccatcaccatcaccatcaccatcaccat

SEQ ID NO: 145 - DNA, 861 bp, Huperzia phlegmaria
atggcttttgtgatcaaagtcaagcccggaaatgtgaatgccactggaaattctcagcacgtcattacggatgccgatgtgaaatccttcggcatccatgacagcgccctcaaggatgccgtcacaaaatacttcggcagatggcccactgacgcttacctcaaaagccccactccttggaatgacctctacaaaacttacggttggccacaggttcagatcgtgcttaaggtccagagctcctcgattactgaggcatcctccaaaccagtgatacttcagtaccaaaattttattaacaagtccaatgaagaagccacttatacagcgaacatgtctcgccagaagaccaattcggcttcccatacctggtccaaccagcacaccttaaaggttgagcagaagatcaaatacgaaatcaacttcggggtcaatgttgggggagaaactaccctgtcctatcagtatgcatttggcgagagtgggacaaaaaccacgaccaccactctctcttcagggtcaggagtgactgtgaaggtaggcccgcataaaaccaagcatgcaatccttcgcgcctcggaaggccagatgaaagtccgcattgtttacgtggctcatctgacggggtctaccgctgtgaattactatcccacgtacaaggggcatcacttctacagcttggatatcgctggagtcatgagcgcaggaggcattagcagcagcaagactataacagaagacgttgtgctggactactactcgcattccactgtggaggttggggatgggccagcgccattgtcagtgtcagcagcagtagccaaaggatcccaccatcaccatcaccatcaccatcaccat

SEQ ID NO: 146 - DNA, 861 bp, Huperzia phlegmaria
atggcttttgtgatcaaagtcaagcccggaaatgtgaatgccactggaaattctcagcacgtcattacggatgccgatgtgaaatccttcggcatccatgacagcgccctcaaggatgccgtcacaaaatacttcggcagatggcccactgacgcttacctcaaaagccccactccttggaatgacctctacaaaacttacggttggccacaggttcagatcgtgcttaaggtccagagctcctcgattactgaggcatcctccaaaccagtgatacttcagtaccaaaattttattaacaagtccaatgaagaagccacttatacagcgaacatgtctcgccagaagaccaattcggcttcccatacctggtccaaccagcacaccttaaaggttgagcagaagatcaaatacgaaatcaacttcggggtcaatgttgggggagaaactaccctgtcctatcagtatgcatttggcgagagtgggacaaaaaccacgaccaccgctctctcttcagggtcaggagtgactgtgaaggtaggcccgcataaaaccaagcatgcaatccttcgcgcctcggaaggccagatgaaagtccgcattgtttacgtggctcatctgacggggtctaccgctgtgaattactatcccacgtacaagggacatcacttctacagcttggatatcgctggagtcatgagcgcaggaggcattagcagcagcaagactataacagaagacgttgtgctggactactactcgcattccactgtggaggttggggatggaccagcgccattgtcagtgtcagcagcagtagccaaaggatcccaccatcaccatcaccatcaccatcaccat

SEQ ID NO: 147 - DNA, 861 bp, Huperzia phlegmaria
atggcttttgtgatcaaagtcaagcccggaaatgtgaatgccactggaaattctcagcacgtcattacggatgccgatgtgaaatccttcggcatccatgacagcgccctcaaggatgccgtcacaaaatacttcggcagatggcccactgacgcttacctcaaaagccccactccttggaatgacctctacaaaacttacggttggccacaggttcagatcgtgcttaaggtccagagctcctcgattaccgaggcatcctccaaaccagtgatacttcagtaccaaaattttattaacaagtccaatgaagaagccacttatacagcgaacatgtctcgccagaagaacaattcggcttcccatacctggtccaaccagcacaccttaaaggttgagcagaagatcaaatacgaaatcaacttcggggtcaatgttgggggagaaactaccctgtcctatcagtatgcatttggcgagagtgggagaaaaaccacgaccaccactctctcttcagggtcaggagtgactgtgaaggtaggcccgcataaaaccaagcatgcaatccttcgcgcctcggaaggccagatgaaagtccgcattgtttacgtggctcatctgacggggtctaccgctgtgaattactatcccacgtacaaggggcatcacttctacagcttgtatatcgctggagtcatgagcgcaggaggcattagcagcagcaagactataacagaagacgttgtgctggactactactcgcattccactgtggaggttggggatggaccagcgccatcgtcagtgtcagcagcagtagccaaaggatcccaccatcaccatcaccatcaccatcaccat

SEQ ID NO: 148 - DNA, 855 bp, Huperzia phlegmaria
atggcttttgtgatcaaagtcaagcccggaaatgtgaatgccactggaaattctcagcacgtcattacggatgccgatgtgaaatccttcggcatccatgacagcgccctcaaggatgccgtcacaaaatacttcggcagatggcccactgacgcttacctcaaaagccccactccttggaatgacctctacaaaacttacggttggccacaggttcagatcgtgcttaaggtccagagctcctcgattaccgaggcatcctccaaaccagtgatacttcagtaccaaaattttattaacaagtccaatgaagaagccacttatacagcgaacatgtcccgccagaagaacaattcggcttcccatacctggtccaaccagcacaccttaaaggttgagcagaagatcaaatgcgaaatcaacttcggggtcaatgttgggggagaaactaccctgtcctatcagtatgcatttggcgagagtgggagaaaaaccacgaccaccactctctcttcagggtcaggagtgactgtgaaggtaggcccgcataaaaccaagcatgcaatccttcgcgcctcggaaggccagatgaaagtccgcactgtttacgtggctcatctgacggggtctaccgctgtgaattactatcccacgtacaaggggcatcacttctacagcttggatatcgctggagtcatgagcgcaggaggcattagcagcagcaagactataacagaagacgttgtgctggactactactcgcattccactgtggaggttggggatggaccagcgccatcgtcagtgtcagcagcagtagccaaaggatcccaccatcaccatcaccatcaccat

SEQ ID NO: 149 - DNA, 861 bp, Huperzia phlegmaria
atggcttttgtgatcaaagtcaagcccggaaatgtgaatgccactggaaattctcagcacgtcattacggatgccgatgtgaaatccttcggcatccatgacagcgccctcaaggatgccgtcacaaaatacttcggcagatggcccactgacgcttacctcaaaagccccactccttggaatgacctctacaaaacttacggttggccacaggttcagatcgtgcttaaggtccagagctcctcgattactgaggcatcctccaaaccagtgatacttcagtaccaaaattttattaacaagtccaatgaagaagccacttatacagcgaacatgtctcgccagaagaacaattcggcttcccatacctggtccaaccagcacaccttaaaggttgagcagaagatcaaatacgaaatcaacttcggggtcaatgttgggggagaaactaccctgtcctatcagtatgcatttggcgagagtgggagaaaaaccacgaccaccactctctcttcagggtcaggagtgactgtgaaggtaggcccgcataaaaccaagcatgcaatccttcgcgcctcggaaggccagatgaaagtccgcattgtttacgtggctcatctgacggggtctaccgctgtgaattactatcccacgtacaaggggcatcacttctacagcttggatatcgctggagtcatgagcgcaggaggcattagcagcagcaagactataacagaagacgttgtgctggactactactcgcattccactgtggaggttggggatggaccagcgccattgtcagtgtcagcagcagtagccaaaggatcccaccatcaccatcaccatcaccatcaccat

SEQ ID NO: 150 - DNA, 861 bp, Huperzia phlegmaria
atggcttttgtgatcaaagtcaagcccggaaatgtgaatgccactggaaattctcagcacgtcattacggatgccgatgtgaaatccttcggcatccatgacagcgccctcaaggatgccgtcacaaaatacttcggcagatggcccactgacgcttacctcaaaagccccactccttggaatgacctctacaaaacttacggttggccacaggttcagatcgtgcttaaggtccagagctcctcgattactgaggcatcctccaaaccagtgatacttcagtaccaaaattttattaacaagtccaatgaagaagccacttatacagcgaacatgtctcgccagaagaacaattcggcttcccatacctggtccaaccagcacaccttaaaggttgagcagaagatcaaatacgaaatcaacttcggggtcaatgttgggggagaaactaccctgtcctatcagtatgcatttggcgagagtgggagaaaaaccacgaccaccactctctcttcagggtcaggagcgactgtgaaggtaggcccgcataaaaccaagcatgcaatccttcgcgcctcggaaggccagatgaaagtccgcattgtttacgtggctcatctgacggggtctaccgctgtgaattactatcccacgtacaaggggcatcacttctacagcttggatatcgctggagtcatgagcgcaggaggcattagcagcagcaagactataacagaagacgttgtgctggactactactcgcattccactgtggaggttggggatggaccagcgccattgtcagtgtcagcagcagtagccaaaggatcccaccatcaccatcaccatcaccatcaccat

SEQ ID NO: 151 - DNA, 861 bp, Huperzia phlegmaria
atggcttttgtgatcaaagtcaagcccggaaatgtgaatgccactggaaattctcagcacgtcattacggatgccgatgtgaaatccttcggcatccatgacagcgccctcaaggatgccgtcacaaaatacttcgatagatggcctactgacgcctacctcagaagccccacgccttggggtgatctctacaccaaatacggttggccgcaggttcagaccgtgctgacggtccagagttctacaattactgaggcatcctccaaaccagtgatacttgattaccagaattttgttaacaaatccagtaaagaagccacttatacagccaacatgtctcgccataagaccaattcggcttccaacacctggtccaaccagcacaccttcaagattgatcagaagattacatacaagatcgacttcggggttaatgctgggggagaaactacgctgtcctatcagtatgcatttggcgagagtgggacaaaaaccacgaccaccactatctcttcagggtcaggagtgactgtgaacgttggcccgcatcaaaccaagcacgcaatccttcgcgcctcggaaggccagatgaaagtccgcattgtttacgttgctcatctgacggggtctactgccgtgaattactatcccacgtacaaggggcatcacttctacagcttggatatcgccgccgtcatgagcaaaggaggcatcagcagcagcaagactataacagaagacattttgctggactactactcgcattccagtgtggaggttggggatggaccagcgccatcgtcagtgtcagcagcagtagccaaaggatcccaccatcaccatcaccatcaccatcaccat

SEQ ID NO: 152 - DNA, 861 bp, Huperzia phlegmaria
atggcttttgtgatcaaagtcaagcccggaaatgtgaatgccactggaaattctcagcacgtcattacggatgccgatgtgaaatccttcggcatccatgacagcgccctcaaggaggccgtcacaaaatacttcgatagatggcctactgacgcctacctcagaagccccacgccttggggtgatctctacaccaaatacggttggccgcaggttcagaccgtgctgacggtccagagttctacaattactgaggcatcctccaaaccagtgatacttgattaccagaattttgttaacaaatccagtaaagaagccacttatacagccaacatgtctcgccataagaccaattcggcttccaacacctggtccaaccagcacaccttcaagattgatcagaagattacatacaagatcgacttcggggttaatgctgggggagaaactacgctgtcctatcagtatgcatttggcgagagtgggacaaaaaccacgaccaccactatctcttcagggtcaggagtgactgtgaacgttggcccgcatcaaaccaagcacgcaatccttcgcgcctcggaaggccagatgaaagtccgcattgtttacgttgctcatctgacggggtctactgccgtgaattactatcccacgtacaaggggcatcacttctacagcttggatatcgccgccgtcatgagcaaaggaggcatcagcagcagcaagactataacagaagacattttgctggactactactcgcattccagtgtggaggttggggatggaccagcgccatcgtcagtgtcagcagcagtagccaaaggatcccaccatcaccatcaccatcaccatcaccat

SEQ ID NO: 153 - DNA, 861 bp, Huperzia phlegmaria
atggcttttttgatcgaagtcaagcccggaaaagtgaatgccactggaaattttcagcatgtcattacggatgccgatgtgaaatccttcggcatccatgacagcgccctcaaggaggccgtcacaaaatacttcgatagatggcctactgacgcctacctcagaagccccacgccttgtggtgatctctacaccaaatacggttggccgcaggttcagaccgtgctgacggtccagagttctacaattactgaggcatcctccaaaccagtgatacttgattaccagaattttgttaacaaatccagtaaagaagccacttatacagccaacatgtctcgccataagaccaattcggcttccaacacctggtccaaccagcacaccttcaagattgatcagaagattacatacaagatcgacttcggggttaatgctgggggagaaactacgctgtcctatcagtatgcatttggcgagagtgggacaaaaaccacgaccaccactatctcttcagggtcaggagtgactgtgaacgttggcccgcatcaaaccaagcacgcaatccttcgcgcctcggaaggccagatgaaagtccgcattgtttacgttgctcatctgacggggtctactgccgtgaattactatcccacgtacaaggggcatcacttctacagcttggatatcgccgccgtcatgagcaaaggaggcatcagcagcagcaagactataacagaagacattttgctggactactactcgcattccagtgtggaggttggggatggaccagcgccatcgtcagtgtcagcagcagtagccaaaggatcccaccatcaccatcaccatcaccatcaccat

SEQ ID NO: 154 - DNA, 861 bp, Huperzia phlegmaria
atggcttttttgatcgaagtcaagcccggaaaagtgaatgccactggaaattttcagcatgtcattacggatgccgatgtgaaatccttcggcatccatgacagcgccctcaaggaggccgtcacaaaatacttcgatagatggcctactgacgcctacctcagaagccccacgccttggggtgatctctacaccaaatacggttggccgcaggttcagaccgtgctgacggtccagagttctacaattactgaggcatcctccaaaccagtgatacttgattaccagaattttgttaacaaatccagtaaagaagccacttatacagccaacatgtctcgccataagaccaattcggcttccaacacctggtccaaccagcacaccttcaagattgatcagaagattacatacaagatcgacttcggggttaatgctgggggagaaactacgctgtcctatcagtatgcatttggcgagagtgggacaaaaaccacgaccaccactatctcttcagggtcaggagtgactgtgaacgttggcccgcatcaaaccaagcacgcaatccttcgcgcctcggaaggccagatgaaagtccgcattgtttacgttgctcatctgacggggtctactgccgtgaattactatcccacgtacaaggggcatcacttctacagcttggatatcgccgccgtcatgagcaaaggaggcatcagcagcagcaagactataacagaagacattttgctggactactactcgcattccagtgtggaggttggggatggaccagcgccatcgtcagtgtcagcagcagtagccaaaggatcccaccatcaccatcaccatcaccatcaccat

SEQ ID NO: 155 - DNA, 867 bp, Huperzia phlegmaria
atggcttttttgatcgaagtcaagcccggaaaagtgaatgccactggaaattttcagcatgtcattacgggtgccgatgtgaaatccttcggcatccatgacagcgccctcaaggaggccgtcacaaaatacttcgatagatggcctactgacgcctacctcagaagccccacgccttggggtgatctctacaccaaatacggttggccgcaggttcagaccgtgctgacggtccagagttctacaattactgaggcatcctccaaaccagtgatacttgattaccagaattttgttaacaaatccagtaaagaagccacttatacagccaacatgtctcgccatgagaccaattcggcttccaacacctggtcccaccagcacaccttcaagattgatcagaagattacatacaaggtcgacttcggggttaatgctgggggagaaactacgctgtcctatcagtatgcatttggcgagagtgggacaaaaaccacgaccaccactatctcttcagggtcaggagtgactgtgaacgttggcccgcatcaaaccaagcacgcaatccttcgcgcctcggaaggccagatgaaagtccgcattgtttacgttgctcatctgacggggtctactgccgtgaattactatcccacgtgcaaggggcatcacttctacagcttggatatcgccgccgtcatgagcaaaggaggcatcagcagcagcaagactataacagaagacattttgctggactactactcgcattccagtgtggaggttggggatggaccagcgccatcgtcagtgtcagcagcagtagccaaaggatcccaccatcaccatcaccatcaccatcaccatcaccat

SEQ ID NO: 156 - DNA, 861 bp, Huperzia phlegmaria
atggcttttgtaatcgacgtcgagcctgaaagtttgaatgtcaccggatattctgagcatgtcatcacggatgacgatgtggatttcttcggcgttggtgacgacgccctcaagaatgccgtccaatcatatttcggccgacgtcccaatgacgcctaccttcgaagccccacgccttggggtgatctctacagcacttacggttggccgcaggtacagaccgttcttcaagtcgtgagctccacagtcactgaggaatcctccaacccagtggcgcttgcttaccagaattttatcaacgattccagtgaagaagccacttatactgctagcatgtcctcccagaagaccaattcggcttcgaatacctggacctccacgaacaccatcaaggtcgatcagaagattcaatacaagatcaacttcggggttgaagctggcggagaaactgacttgtcttatcagtacgcgtttggcgagagcgggacaaaatccaccaccttcacaataagttcaggttcatcagtgactttgcaggtagacccgcatcaaaccaagcatgcaatcctacaagcctcgcaaggccagaagaaaattaggaacacgtatgtggcctatctgatcggatctactgctgtgaattacaatcctacgtacaagggacatcacttctgggacatggatatcgctgaagtcatgagcagcggaggcattagcaacagcaagattatgacagaggacatctcattggacttctactcgaattccagtgtggaggttggggatggaccagcgccaacgtcagtgacattgtcaatagccgaaggatcccaccatcaccatcaccatcaccatcaccat

SEQ ID NO: 157 - DNA, 861 bp, Huperzia phlegmaria
atggcttttgtaatcgacgtcgagcctgaaagtttgaatgtcaccggatattctgagcatgtcatcacggatgacgatgtgaatttcttcggcgttggtgacgacgccctcaagaatgccgtcaactcatttttcggccaacggcccaatgacgccttcctcagaagccccacgccttggggtgatctctacagcacttacggttggccgcaggtacagacctttcttcaagtcgtgagctccacagtcactgaggaatcctccaacccagtgacgcttgcttaccagaattttatcaacgattccagtgaagaagccacttatactgctagcatgtcctcccagaagaccaattcggcttcgaatacctggacctccacgaacaccatcaaggtcgatcagaagattcaatacaagatcaacttcggggttgaagctggcggagaaactgacttgtcttatcagtacgcgtttggcgagagcgggacacaatccaccaccttcacaataagttcaggttcatcagtgactgtgcaggtagacccgcatcaaaccaagcacgcaatccttaaagcctcgcaaggccagaagaaagttaggatcacgtatttggccagtctaatcggatctactgctgtgaattacgatcctacgtacaagggacatcacttctgggacatggatatcggtgcagtcatgagcagcggaggcattagcaacagcaagattatgacagaggacatctcattggacttcttctcgaattccagtgtggaggttggggatggaccagcgccaacgtcagtgacattgtcaatagccgaaggatcccaccatcaccatcaccatcaccatcaccat

SEQ ID NO: 158 - DNA, 861 bp, Huperzia phlegmaria
atggcttttgtaatcgacgtcgagcctgaaagtttgaatgtcaccggatattctgagcatgtcatcacggatgacgatgtggatttcttcggcgttggtgacgacgccctcaagaatgccgtccaatcatatttcggccgacgtcccaatgacgcctaccttcgaagccccacgccttggggtgatctctacagcacttacggttggccgcaggtacagaccgttcttcaagtcgtgagctccacagtcactgaggaatcctccaacccagtggcgcttgcttaccagaattttatcaacgattccagtgaagaagccacttatactgctagcatgtcctcccagaaggccaattcggcttcgaatacctggacctccacgaacaccatcaaggtcgatcagaagattcaatacaagatcaacttcggggttgaagctggcggagaaactgacttgtcttatcagtacgcgtttggcgagagcgggacaaaatccaccaccttcacaataagttcaggttcatcagtgactttgcaggtagacccgcatcaaaccaagcatgcaatcctacaagcctcgcaaggccagaagaaaattaggaacacgtatttggccagtctaatcggatctactgctgtgaattacgatcctacgtacaagggacatcacttctgggacatggatatcggtgcagtcatgagcagcggaggcattagcaacagcaagattatgacagaggacatctcattggacttctactcgaattccagtgtggaggttggggatggaccagcgccaacgtcagtgacattgtcaatagccgaaggatcccaccatcaccatcaccatcaccatcaccat

SEQ ID NO: 159 - DNA, 861 bp, Huperzia phlegmaria
atggcttttgtaatcgacgtcgagcctgaaagtttgaatgtcaccggatattctgagcatgtcatcacggatgacgatgtgaatttcttcggcgttggtgacgacgccctcaagaatgccgtcaactcatttttcggccaacggcccaatgacgccttcctcagaagccccacgccttggggtgatctctacagcacttacggttggccgcaggtacagaccgttcttcaagtcgtgagctccacagtcactgaggaatcctccaacccagtggcgcttgcttaccagaattttatcaacgattccagtgaagaagccacttatactgctagcatgtcctcccagaagaccaattcggcttcgaataactggaccgccacgaacaccatcaaggtcgatcagaagattcaatacaagatcaacttcggggttgaagctggcggagaaactgacttgtcttatcagtacgcgtttggcgagagcgggacacaatccaccaccttcacaataagttcaggttcatcagtgactgtgcaggtagacccgcatcaaaccaagcacgcaatccttaaagcctcgcaaggccagaagaaagttaggatcacgtatttggccagtctaatcggatctactgctgtgaattacgatcctacgtacaagggacatcacttctgggacatggatatcggtgcagtcatgagcagcggaggcattagcaacagcaagattatgacagaggacatctcattggacttctactcgaattccagtgtggaggttggggatggaccagcgccaacgtcagtgacattgtcaatagccgaaggatcccaccatcaccatcaccatcaccatcaccat

SEQ ID NO: 160 - protein, 297 aa, Huperzia phlegmaria
MSIQIDIEPGNVRVSGSSRHIITDADVRTFGLNDNALKNAVLAHLGRRPNDAFLRSPTPWGDLYSTYGWPQVQTVLAVRSSQILEETSRPVMLAYQNFVNNTNTEATYTASMSRAVTNSSSNTWSNTHSLTFEQKIKYGINFGITAEGETTLSYEFSFGQSGTESVSTTLSTGAGVSVVVAPHRTKHAILSASEGRMRVRIRYEAYLTGSTAVNYNPRHNGHHFWGLGIAGVMRSGNISNTRTITEDISLQSYSNGSVVLGEGPAPISLVEAVETLNEKATAPIPEPLEEEEEEKKE

SEQ ID NO: 161 - protein, 302 aa, Phlegmariurus nummularifolius
MSIQIDIEPGNVRVSGSSRHIITDADVRTFGLNDNALKNAVLAHFERRPNDAFLRSPTPWGDLYTSYGWPQVQTVLAVRSSQILEETSRPVMLAYQTFVNNTNTEATYTANMSRVMRNSSSNAWSNTHSLSFQQKIKYGINFGITAQGETTLSYKFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGRVLLEEGPAPISLVEEVTTLNEKATAPIPVIESTEPLEEEEEEKKE

SEQ ID NO: 162 - protein, 302 aa, Phlegmariurus nummularifolius
MAFVIDIEPGNVRVSGSSRHIITDADVRTFGLNDNALKNAVQAHFERRPNDAFLRSPTPWGDLYTSYGWPQVQTVLAVRSSQILEETSRPVMLAYQNFVNNTNTEATYTADMSRAMTNSSSNTWSNTHSLSFQQKITYGINFGITAEGETTLSYQFSFGQSGTESVSTTISTGAGVSVVVAPHRTKHAILIASEGRMRVRIRYEAYLTGSTAVNYNPRHRGHHFWGLGIAGVMRSGNISNTRTITEDISLQSYSNGRVLLEEGPAPISLVEEVTTLNEKATAPIPVIESTEPLEEEEEEKKE

SEQ ID NO: 163 - protein, 302 aa, Phlegmariurus nummularifolius
MAFVIDIEPGNVRVSGSSRHIITDADVRTFGLNDNALKNAVLAHFERRPNDAFLRSPTPWGDLYTSYGWPQVQTVLAVRSSQILEETSRPVMLAYQTFVNNTNTEATYTANMSRVMRNSSSNAWSNTHSLSFQQKIKYGINFGITAQGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGRVVLEEGPAPISLVEEVTTLNEKATAPIPVIESTEPLEEEEEEKKE

SEQ ID NO: 164 - protein, 302 aa, Phlegmariurus nummularifolius
MSIQIDIEPGSVRVSGSSRHIITDGDVRTFGLNDNALKNAVLAHFERRPNDAFLRSPTPWGDLYTTYGWPQVQTVLAVRSSQILEETSRPVMLAYQNFVNNTNTEATYTANMSREVTNSSSNTWSNTHSLTFEQKIKYGINFGITAEGETTLSYEFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEEEKKE

SEQ ID NO: 165 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTANMSRAMTNSSSNTWSNTHSLTFEQKIKYGINFGITAEGETTLSYEFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEEEKKE

SEQ ID NO: 166 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTANMSRAMTNSSSNTWSNTHSLSFQQKIKYGINFGITAEGETTLSYEFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSIVLGEGPAPISLVEEVTTLNEKATAPIPVIESTEPLEEEEEEKKE

SEQ ID NO: 167 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTANMSRAMTNSSSNTWSNTHSLSFQQKIKYGINFGITAEGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEEEKKE

SEQ ID NO: 168 - protein, 302 aa, Phlegmariurus nummularifolius
MSIQIDIEPGNVRVSGSSRHIITDADVRTFGLNDNALKNAVLAHLGRRPNDAFLRSPTPWGDLYTSYGWPQVQTVLAVRSSQILEETSRPVMLAYQNFVNNTNTEAEYTANMSREMTNSSSNTWSNTHSLTFEQKIKYGINFGITAEGETTLSYEFSFGQSGTESVSTTLSTGAGVSVMVGPHRTKHVILSASEGRMRVRIRYEAYMTGSTAVNYNPRHNGHHFWGLGIAGVMRSGNISNTRTITEDISLQSYSNSSVVLGEGPAPISLVEAVETLNEKATAPPPVVESIPMEEEEEEEKKE

SEQ ID NO: 169 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTANMSRAMTNSSSNTWSNTHSLSFQQNIKYGINFGITAEGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSVVLGEGPAPISLVEEVTTLNEKATAPIPVIESTEPLEEEEEEKKE

SEQ ID NO: 170 - protein, 302 aa, Phlegmariurus nummularifolius
MSIQIDIEPGNVRVSGSSQHIITDADVRTFGLNDNALKNAVQAHFERRPNDAFLRSPTPWGDLYTTYGWPQVQTVLAVRSSQILEETSRPVMLAYQNFVNNTNTEATYTANMSRAMTNSSSNTWSNTHSLSFQQKIKYGINFGITAEGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSVVLGEGPAPISLVEEVTTLNEKATAPIPVIESTEPLEEEEEEKKE

SEQ ID NO: 171 - protein, 302 aa, Phlegmariurus nummularifolius
MSIQIDIEPGNVRVSGSSQHIITDADVRTFGLNDNALKNAVLAHFERRPNDAFLRSPTPWGDLYTTYGWPQVQTVLAVRSSQILEETSRPVMLAYQNFVNNTNTEATYTANMSRAMTNSSSNTWSNTHSLSFQQKIKYGINFGITAEGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSVVLGEGPAPISLVEEVTTLNEKATAPIPVIESTEPLEEEEEEKKE

SEQ ID NO: 172 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTANMSRAMTNSSSNTWSNTHSLSFQQKIKYGINFGITAQGETTLSYKFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGRVVLEEGPAPISLVEEVTTLNEKATAPIPVIESTEPLEEEEEEKKE

SEQ ID NO: 173 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLDYRNFVNNTNTEATYTANMSREVTNSSSNTWSNTHSLTFEQKIKYGINFGITAEGETTLSYEFSFGQSGTESVSTTLSTGAGVSVMVGPHRTKHVILSASEGRMRVRIRYEAYMTGSTAVNYNPRHNGHHFWGLGIAGVMRSGNISNTRTITEDISLQSYSNSSVVLGEGPAPISLVEAVETLNEKATAPPPVVESIPMEEEEEEEKKE

SEQ ID NO: 174 - protein, 302 aa, Phlegmariurus nummularifolius
MSIQIDIEPGNVRVSGSSRHIITDADVRTFGLNDNALKNAVQAHFERRPNDAFLRSPTPWGDLYTSYGWPQVQTVLAVRSSQILEETSRPVMLAYQNFVNNTNTEATYTANMSRAMTNSSSNTWSNTHSLSFQQKIKYGINFGITAQGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGSVVLGEGPAPISLVEEVTTLNEKATAPIPVIESTEPLEEEEEEKKE

SEQ ID NO: 175 - protein, 302 aa, Phlegmariurus nummularifolius
MAFVIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTANMSRAMTNSSSNTWSNTHSLSFQQKIKYGINFGITAEGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSVVLGEGPAPISLVEEVTTLNEKATAPIPVIESTEPLEEEEEEKKE

SEQ ID NO: 176 - protein, 301 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTANMSREVTNSSSNTWSNTHSLTFEQKIKYGINFGITAEGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGRVLLEEGPAPISLVEEVTTLNEKATAPIPVIESTEPLEEEEEEKD

SEQ ID NO: 177 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLDYQNFVNNTNTEATYTANMSRAVTNSSSNTWSNTHSLAFEQKIKYGINFGITAQGETTLSYEFSFGQSGTKSVSTTISTGAGVSVVVGPHRTKHAILSASEGRMRVRIRYEAYLTGSTAVNYNPPHRGHHFWGLGIAGVMRSGNISNTRTITEDISLLSYSNGSVVLGEGPAPLSLVEEVKTLNEKATAPIPVIESTEPLEEEEEEKKE

SEQ ID NO: 178 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTANMSRAMTNSSSNTWSNTHSLSFQQKIKYGINFGITAEGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGRVLLEEGPAPISLVEEVTTLNEKATAPIPVIESTEPLEEEEEEKKE

SEQ ID NO: 179 - protein, 302 aa, Phlegmariurus nummularifolius
MAFVIDIEPGSVRVSGSSRHIITDGDVRTFGLNDNALKNAVLAHFERRPNDAFLRSPTPWGDLYTTYGWPQVQTVLAVRSSQILEETSRPVMLAYQNFVNNTNTEATYTANMSREVTNSSSNTWSNTHSLTFEQKIKYGINFGITAEGETTLSYEFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEEEKKE

SEQ ID NO: 180 - protein, 301 aa, Phlegmariurus nummularifolius
MSIQIDIEPGNVRVSGSSRHIITDADVRTFGLNDNALKNAVLAHFERRPNDAFLRSPTPWGDLYTSYGWPQVQTVLAVRSSQILEETSRPVMLDYQNFVNNTNTEATYPANMSRAVTTSLSNTWSNTHSLAFEQKIKYGINFGITAEGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSVVLGEGPAPISLVEEVTTLNEKATAPIPVIESTEPLEEEEEEKD

SEQ ID NO: 181 - protein, 301 aa, Phlegmariurus nummularifolius
MSIQIDIEPGNVRVSGSSRHIITDADVRTFGLNDNALKNAVQAHFERRPNDAFLRSPTPWGDLYTSYGWPQVQTVLAVRSSQILEETSRPVMLAYQNFVNNTNTEATYTANMSRAMTNSSSNTWSNTHSLSFQQKIKYGINFGITAQGETTLSYKFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGRVLLEEGPAPISLVEEVTTLNEKATAPIPVIESTEPLEEEEEEKR

SEQ ID NO: 182 - protein, 301 aa, Phlegmariurus nummularifolius
MSIQIEIEPGNVRVSGSSRHIITDADVRTFGLNDNALKNAVQAHFERRPNDAFLRSPTPWGDLYTSYGWPQVQTVLAVRSSQILEETSRPVMLAYQNFVNNTNTEATYTANMSRAMTNSSSNTWSNTHSLSFQQKITYGINFGITAEGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEEEKD

SEQ ID NO: 183 - protein, 302 aa, Phlegmariurus nummularifolius
MAFLIDIEPGNVRVSGSSQHIITDADVRTFGLNDNALKNAVQAHFERRPNDAFLRSPTPWGDLYTTYGWPQVQTVLAVRSSQILEETSRPVMLAYQNFVNNTNTEATYTANMSRAVTNSSSNTWSNTHSLAFEQKIKYGINFGITAQGETTLSYEFSFGQSGTESVSTTISTGAGVSVVVGPHRTKHAILSASEGRMRVRIRYEAYLTGSTAVNYNPRHRGHHFWGLGITGVMRSGNISNTRTITEDISLLSYSNGSVVLGEGPAPLSLVEEVKTLNEKATAPIPVIESTEPLEEEEEEKKE

SEQ ID NO: 184 - protein, 301 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLDYRNFVNNTNTEATYTANMSRSVTNSSSNTWSNTHSLAFEQKIKYGINFGITAQGETTLSYEFSFGQSGTESVSTTISTGAGVSVVVGPHRTKHAILSASEGRMRVRIRYEAYLTGSTAVNYNPRHRGHHFWGLGIAGVMRSGNISNTRTITEDISLLSYSNGSVVLGEGPAPLSLVEEVKTLNEKATAPIPVIESTELLEEEEEKKE

SEQ ID NO: 185 - protein, 301 aa, Phlegmariurus nummularifolius
MSIQIDIEPGNVRVSGSSRHIITDADVRTFGLNDNALKNAVQAHFERRPNDAFLRSPTPWGDLYTSYGWPQVQTVLAVRSSQILEETSRPVMLAYQNFVNNTNTEATYTANMSRAMTNSSSNTWSNTHSLSFQQKITYGINFGITAEGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEEEKD

SEQ ID NO: 186 - protein, 302 aa, Phlegmariurus nummularifolius
MSIQIDIEPGNVRVSGSSQHIITDADVRTFGLNDNALKNAVQAHFERRPNDAFLRSPTPWGDLYTSYGWPQVQTVLAVRSSQILEETSRPVMLDYQNFVNNTNTEATYTANMSRAVTNSSSNTWSNTHSLAFEQKIKYGINFGITAQGETTLSYEFSFGQSGTKSVSTTISTGAGVSVVVGPHRTKHAILSASEGRMRVRIRYEAYLTGSTAVNYNPPHRGHHFWGLGIAGVMRSGNISNTRTITEDISLLSYSNGSVVLGEGPAPLSLVEEVKTLNEKATAPIPVIESTEPLEEEEEEKKE

SEQ ID NO: 187 - protein, 302 aa, Phlegmariurus nummularifolius
MSIQIDIEPGNVRVSGSSRHIITDADVRTFGLNDNALKNAVQAHFERRPNDAFLRSPTPWGDLYTSYGWPQVQTVLAVRSSQILEETSRPVMLAYQTFVNNTNTEATYTANMSRVMRNSSSNAWSNTHSLSFQQKIKYGINFGITAQGETTLSYKFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGSVVLGEGPAPISLVEEVTTLNEKATAPIPVIESTEPLEEEEEEKKE

SEQ ID NO: 188 - protein, 301 aa, Phlegmariurus nummularifolius
MSIQIDIEPGNVRVSGSSQHIITDADVRTFGLNDNALKNAVQAHFERRPNDAFLRSPTPWGDLYTSYGWPQVQTVLAVRSSQILEETSRPVMLAYQNFVNNTNTEATYTANMSRAMTNSSSNTWSNTHSLSFQQKITYGINFGITAEGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEEEKD

SEQ ID NO: 189 - protein, 301 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLDYQNFVNNTNTEATYPANMSRAVTTSLSNTWSNTHSLAFEQKIKYGINFGITAEGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSVVLGEGPAPISLVEEVTTLNEKATAPIPVIESTEPLEEEEEEKD

SEQ ID NO: 190 - protein, 301 aa, Phlegmariurus nummularifolius
MSIQIDIEPGNVRVSGSSQRIITDADVRTFGLNDNALKNAVQAHFERRPNDAFLRSPTPWGDLYTSYGWPQVQTVLAVRSSQILEETSRPVMLAYQNFVNNTNTEATYTANMSRAMTNSSSNTWSNTHSLSFQQKITYGINFGITAEGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEEEKD

SEQ ID NO: 191 - protein, 301 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTANMSREVTNSSSNTWSNTHSLAFQQKIKYGINFGITAEGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLLSYSNGSVVLGEGPAPLSLVEEVKTFNEKATAPIPVIESTELLEEEEEKKE

SEQ ID NO: 192 - protein, 302 aa, Phlegmariurus nummularifolius
MSIQIDIEPGNVRVSGSSRHIITDADVRTFGLNDNALKNAVQAHFERRPNDAFLRSPTPWGDLYTSYGWPQVQTVLAVRSSQILEETSRPVMLAYQNFVNNTNTEATYTANMSRAMTNSSSNTWSNTHSLSFQQKITYGINFGITAEGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGRVLLEEGPAPISLVEEVTTLNEKATAPIPVIESTEPLEEEEEEKKE

SEQ ID NO: 193 - protein, 302 aa, Phlegmariurus nummularifolius
MSIQIDIEPGSVRVSGSSRHIITDGDVRTFGLNDNALKNAVLAHFERRPNDAFLRSPTPWGDLYTTYGWPQVQTVLAVRSSQILEETSRPVMLAYQNFVNNTNTEAEYTANMSREMTNSSSNTWSNTHSLTFEQKIKYGINFGITAEGETTLSYEFSFGQSGTESVSTTLSTGAGVSVMVGPHRTKHVILSASEGRMRVRIRYEAYMTGSTAVNYNPRHNGHHFWGLGIAGVMRSGNISNTRTITEDISLQSYSNGRVLLEEGPAPISLVEEVTTLNEKATAPIPVIESTEPLEEEEEEKKE

SEQ ID NO: 194 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQTFVNNTNTEATYTANMSRVMRNSSSNAWSNTHSLSFQQKIKYGINFGITAQGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGRVVLEEGPAPISLVEEVTTLNEKATAPIPVIESTEPLEEEEEEKKE

SEQ ID NO: 195 - protein, 302 aa, Phlegmariurus nummularifolius
MSIQIDIEPGNVRVSGSSRHIITDADVRTFGLNDNALKNAVLAHFERRPNDAFLRSPTPWGDLYTSYGWPQVQTVLAVRSSQILEETSRPVMLAYQTFVNNTNTEATYTANMSRVMRNSSSNAWSNTHSLSFQQKIKYGINFGITAQGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGRVVLEEGPAPISLVEEVTTLNEKATAPIPVIESTEPLEEEEEEKKE

SEQ ID NO: 196 - protein, 301 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLDYRNFVNNTNTEATYTANMSPSVTNSSSNTWSNTHSLAFEQKIKYGINFGITAQGETTLSYEFSFGQSGTESVSTTISTGAGVSVVVGPHRTKHAILSASEGRMRVRIRYEAYLTGSTAVNYNPRHRGHHFWGLGIAGVMRSGNISNTRTITEDISLLSYSNGSVVLGEGPAPLSLVEEVKTLNEKATAPIPVIESTELLEEEEEKKE

SEQ ID NO: 197 - protein, 302 aa, Phlegmariurus nummularifolius
MSIQIDIEPGNVRVSGSSQHIITDADVRTFGLNDNALKNAVQAHFERRPNDAFLRSPTPWGDLYTSYGWPQVQTVLAVRSSQILEETSRPVMLAYQTFVNNTNTEATYTANMSRVMRNSSSNAWSNTHSLSFQQKIKYGINFGITAQGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGSVVLGEGPAPISLVEEVTTLNEKATAPIPVIESTEPLEEEEEEKKE

SEQ ID NO: 198 - protein, 302 aa, Phlegmariurus nummularifolius
MAFVIDIEPGSVRVSGSSRHIITDADVRTFGLNDNALKNAVQAHFERRPNDAFLRSPTPWGDLYTSYGWPQVQTVLAVRSSQILEETSRPVMLAYQNFVNNTNTEATYTADMSRAMTNSSSNTWSNTHSLSFQQKITYGINFGITAEGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEEEKKE

SEQ ID NO: 199 - protein, 301 aa, Phlegmariurus nummularifolius
MAFLIDIEPGSVRVSGSSRHIITDADVRTFGLNDNALKNAVQAHFERRPNDAFLRSPTPWGDLYTSYGWPQVQTVLAVRSSQILEETSRPVMLAYQNFVNNTNTEATYTADMSRAMTNSSSNTWSNTHSLSFQQKITYGINFGITAEGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEKRRR

SEQ ID NO: 200 - protein, 302 aa, Phlegmariurus nummularifolius
MSIQIDIEPGNVRVSGSSQHIITDADVRTFGLNDNALKNAVQAHFERRPNDAFLRSPTPWGDLYTSYGWPQVQTVLAVRSSQILEETSRPVMLAYQTFVNNTNTEATYTANMSRVMRNSSSNAWSNTHSLSFQQKIKYGINFGITAQGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGRVLLEEGPAPISLVEEVTTLNEKATAPIPVIESTEPLEEEEEEKKE

SEQ ID NO: 201 - protein, 301 aa, Phlegmariurus nummularifolius
MSIQIDIEPGNVRVSGSSRHIITDADVRTFGLNDNALKNAVQAHFERRPNDAFLRSPTPWGDLYTSYGWPQVQTVLAVRSSQILEETSRPVMLAYQNFVNNTNTEATYTANMSRVMRNSSSNAWSNTHSLSFQQKIKYGINFGITAQGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLLSYSNGSVVLGEGPAPLSLVEEVKTLNEKATAPIPVIESTELLEEEEEKKE

SEQ ID NO: 202 - protein, 302 aa, Phlegmariurus nummularifolius
MAFVIDIEPGNVRVSGSSRHIITDADVRTFGLNDNALKNAVQAHFERRPNDAFLRSPTPWGDLYTSYGWPQVQTVLAVRSSQILEETSRPVMLAYQTFVNNTNTEATYTANMSRVMRNSSSNAWSNTHSLSFQQKIKYGINFGITAQGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEEEKKE

SEQ ID NO: 203 - protein, 302 aa, Phlegmariurus nummularifolius
MSIQIDIEPGNVRVSGSSQHIITDADVRTFGLNDNALKNALQAHFERRPNDAFLRSPTPWGDLYTSYGWPQVQTVLAVRSSQILEETSRPVMLAYQTFVNNTNTEATYTANMSRVMRNSSSNAWSNTHSLSFQQKIKYGINFGITAQGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGRVLLEEGPAPISLVEEVTTLNEKATAPIPVIESTEPLEEEEEEKKE

SEQ ID NO: 204 - protein, 302 aa, Phlegmariurus nummularifolius
MAFVIDIEPGNVRVSGSSRHIITDADVRTFGLNDNALKNAVLAHFERRPNDAFLRSPTPWGDLYTSYGWPQVQTVLAVRSSQILEETSRPVMLAYQTFVNNTNTEATYTANMSRVMRNSSSNAWSNTHSLSFQQKIKYGINFGITAQGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSVVLGEGPAPISLVEEVTTLNEKATAPIPVIESTEPLEEEEEEKKE

SEQ ID NO: 205 - protein, 301 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTANMSRAMTNSSSNTWSNTHSLSFQQKIKYGINFGITAEGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSVVLGEGPAPISLVEEVTTLNEKATAPIPVIESTEPLEEEEEEKD

SEQ ID NO: 206 - protein, 302 aa, Phlegmariurus nummularifolius
MSIQIDIEPGNVRVGGSSRHIITDADVRTFGLNDNALKNAVLAHFERRPNDAFLRSPTPWGDLYTTYGWPQVQTVLAVRSSQILEETSRPVMLAYQNFVNNTNTEATYTANMSRAMTNSSSNTWSNTHSLSFQQKIKYGINFGITAEGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSVVLGEGPAPISLVEEVTTLNEKATAPIPVIESTEPLEEEEEEKDG

SEQ ID NO: 207 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTANMSRAMTNSSSNTWSNTHSLSFQQKIKYGINFGITAEGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLLSYSNGSVVLGEGPAPLSLVEEVKTLNEKATAPIPVIESTEPLEEEEEEQKE

SEQ ID NO: 208 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTANMSRAMTNSSSNTWSNTHSLSFQQKIKYGINFGITAEGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSVVLGEGPAPISLVEEVTTLNEKATAPIPVIESTEPLEEEEEEKKE

SEQ ID NO: 209 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTANMSRAMTNSSSNTWSNTHSLSFQQKIKYGINFGITAEGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGRVPLEEGPAPISLVEEVTTLNEKATAPIPVIESTEPLEEEEEEKKE

SEQ ID NO: 210 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTANMSRAMTNSSSNTWSNTHSLSFQQKIKYGINFGITAEGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGRVLLEEGPAPISLVEEVTTLNEKATAPIPVIESTEPLEEEEEEKKE

SEQ ID NO: 211 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTANISRAMTNSSSNTWSNTHSLSFQQKIKYGINFGITAEGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSVVLGEGPAPISLVEEVTTLNEKATAPIPVIESTEPLEEEEEEKKE

SEQ ID NO: 212 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTADMSRAMTNSSSNTWSNTHSLSFQQKITYGINFGITAEGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEEEKKE

SEQ ID NO: 213 - protein, 302 aa, Phlegmariurus nummularifolius
MSIQIDIEPGNVRVSGSSQHIITDADVRTFGLNDNALKNAVQAHFERRPNDAFLRGPTPWGDLYTSYGWPQVQTVLAVRSSQILEETSRPVMLAYQTFVNNTNTEATYTANMSRVMRNSSSNAWSNTHSLSFQQKIKYGINFGITAQGETTLSYKFSFGQSGTESVSTTISTGAGVSVVVAPHRTKHAILSASEGRMRVRIRYEAYLTGSTAVNYNPRHRGHHFWGLGIAGVMRSGDISNTRTITEDISLQSYSNGRVLLEEGPAPISLVEEVTTLNEKATAPIPVIESTEPLEEEEEEKKE

SEQ ID NO: 214 - protein, 302 aa, Phlegmariurus nummularifolius
MSIQIDIEPGNVRVSGSSQHIITDADVRTFGLNDNALKNAVQAHFERRPNDAFLRSPTPWGDLYTSYGWPQVQTVLAVRSSQILEETSRPVMLAYQTFVNNTNTEATYTANMSRVMRNSSSNAWSNTHSLSFQQKIKYGINFGITAQGETTLSYKFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGRVLLEEGPAPISLVEEVTTLNEKATAPIPVIESTEPLEEEEEEKKE

SEQ ID NO: 215 - protein, 302 aa, Phlegmariurus nummularifolius
MSIQIDIEPGSVRVSGSSRHIITDGDVRTFGLNDNALKNAVLAHFERRPNDAFLRSPTPWGDLYTTYGWPQVQTVLAVRSSQILEETSRPVMLAYQTFVNNTNTEATYTANMSRVMRNSSSNAWSNTHSLSFQQKIKYGINFGITAEGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSVVLGEGPAPISLVEEVTTLNEKATAPIPVIESTEPLEEEEEEKKE

SEQ ID NO: 216 - protein, 302 aa, Phlegmariurus nummularifolius
MSIQIDIEPGSVRVSGSSRHIITDGDVRTFGLNDNALKNAVLAHFERRPNDAFLRSPTPWGDLYTTYGWPQVQTVLAVRSSQILEETSRPVMLAYQTFVNDTNTEATYTANMSRVMRNSSSNAWSNTHSLSFQQKIKYGINFGITAEGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSVVLGEGPAPISLVEEVTTLNEKATAPIPVIESTEPLEEEEEEKKE

SEQ ID NO: 217 - protein, 302 aa, Phlegmariurus nummularifolius
MSIQIDIEPGSVRVSGSSRHIITDGDVRTFGLNDNALKNAVLAHFERRPNDAFLRSPTPWGDLYTTYGWPQVQTVLAVRSSQILEETSRPVMLAYQTFVNNTNTEATYTANMSRVMRNSSSNAWSNTHSLSFQQKIKYGINFGITAEGETTLSYQFSFGQSGTESVSTTVSTGAGVSVVVGPHRTKHAILSASEGRMRVRIRYEAYLTGSTAVNYNPRHRGHHFWGLGIAGVMRSGNISNTRTITEDISLQSYSNGSVVLGEGPAPISLVEEVTTLNEKATAPIPVIESTEPLEEEEEEKKE

SEQ ID NO: 218 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTANMSRAVTNSSSNTWSNTHSLAFEQKIKYGINFGITAQGETTLSYEFSFGQSGTESVSTKISTGAGVSVVVGPHRTKHAILSASEGRMRVRIRYEAYLTGSTAVNYNPRHRGHHFWGLGIAAVMRSGNISNTRTITEDISLLSYSNGSVVLGEGPAPLSLVEEVKTLNEKATAPIPVIESTEPLEEEEEEKKE

SEQ ID NO: 219 - protein, 302 aa, Phlegmariurus nummularifolius
MSIQIDIEPGSVRVSGSSRHIITDGDVSTFGLNDNALKNAVLAHFERRPNDAFLRSPTPWGDLYTTYGWPQVQTVLAVRSSQILEETSRPVMLAYQNFVNNTNTEATYTANMSREVTNSSSNTWSNTHSLTFEQKIKYGINFGITAEGETTLSYEFSFGQSGTESVSTTISTGAGVSVVVGPHRTKHAILSASEGRMRVRIRYEAYLTGSTAVNYNPRHRGHHFWGLGIAGVMRSGNISNTRTITEDISLLSYSNGSVVLGEGPAPLSLVEEVKTLNEKATAPIPVIESTEPLEEEEEEKKE

SEQ ID NO: 220 - protein, 302 aa, Phlegmariurus nummularifolius
MSIQIDIEPGNVRVSGSSRHIITDADVRTFGLNDNALKNAVLAHLGRRPNDAFLRSPTPWGDLYTSYGWPQVQTVLAVRSSQILEETSRPVMLAYQNFVDNTNTEAEYTANMSREMTNSSSNTWSNTHSLTFEQKIKYGINFGITAEGETTLSYEFSFGQSGTESVSTTLSTGAGVSVMVGPHRTKHVILSASEGRMRVRIRYEAYMTGSTAVNYNPRHNGHHFWGLGIAGVMRSGNISNTRTITEDISLQSYSNSSVVLGEGPAPISLVEAVETLNEKATAPPPVVESIPMEEEEEEEKKE

SEQ ID NO: 221 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTANMSRSVTNSSSNTWSNTHSLAFEQKIKYGINFGITAQGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGRVLLEEGPAPISLVEEVTTLNEKATAPIPVIESTEPLEEEEEEKKE

SEQ ID NO: 222 - protein, 302 aa, Phlegmariurus nummularifolius
MSIQIDIEPGNVRVSGSSRHIITDADVRTFGLNDNALKNAVLAHFERRPNGAFLRSPTPWGDLYTTYGWPQVQTVLAVRSSQILEETSRPVMLAYQNFVNNTNTEATYTANMSRSVTNSSSNTWSNTHSLAFEQKIKYGINFGITAQGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGRVLLEEGPAPISLVEEVTTLNEKATAPIPVIESTEPLEEEEEEKKE

SEQ ID NO: 223 - protein, 302 aa, Phlegmariurus nummularifolius
MSIQIDIEPGNVRVSGSSRHIITDADVRTFGLNDNALKNAVQAHFERRPNDAFLRSPTPWGDLYTSYGWPQVQTVLAVRSSQILEETSRPVMLAYQNFVNNTNTEATYTANMSRAMTYSSSNTWSNTHSLSFQQKIKYGINFGITAQGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEEEKKE

SEQ ID NO: 224 - protein, 302 aa, Phlegmariurus nummularifolius
MSIQIDIEPGNVRVSGSSRHIITDADVRTFGLNDNALKNAVQAHFERRPNDAFLRSPTPWGDLYTSYGWPQVQTVLAVRSSQILEETSRPVMLAYQNFVNNTNTEATYTANMPRAMTNSSSNTWSNTHSLSFQQKIKYGINFGITAQGETTLSYQFSFGQSGTESVSTTISTGAGVSVVVAPHRTKHAILSASEGRMRVRIRYEAYLTGSTAVNYNPRHRGHHFWGLGIAGVMRSGNISNTRAITEDISLQSYSNGSIVLGEGPAPISLVEEVKTLNEKATAPIPVIESTEPLEEEEEEKKE

SEQ ID NO: 225 - protein, 302 aa, Phlegmariurus nummularifolius
MSIQIDIEPGNVRVSGSSRHIITDADVRTFGLNDNALKNAVQAHFERRPNDAFLRSPTPWGDLYTSYGWPQVQTVLAVRSSQILEETSRPVMLAYQNFVNNTNTEATYTANMSRAMTNSSSNTWSNTHSLSFQQKIKYGINFGITAQGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEEEKKK

SEQ ID NO: 226 - protein, 302 aa, Phlegmariurus nummularifolius
MSILIDIKPGSVRVSGSSRHIITDADVRTFGLNDNALNNAVLAHLGRRPNDAFLRSPTPWGDLYTSYGWPQVQTVLAVRSSQILEETSRPVMLAYQNFVNNTNTEAEYTANMSREMTNSSSNTWSNTHSLTFEQKIKYGINFGITAEGETTLSYEFSFGQSGTESVSTTLSTGAGVSVMVGPHRTKHVILSASEGRMRVRIRYEAYMTGSTAVNYNPRHRGHHFWGLGIAGVMRSGNISNTRTITEDISLQSYSNGRVLLEEGPAPISLVEEVTTLNEKATAPIPVIESTEPLEEEEEEKKE

SEQ ID NO: 227 - protein, 302 aa, Phlegmariurus nummularifolius
MSIQIDIEPGNVRVSGSSRHIITDADVRTFGLNDNALKNAVLAHLGRRPNDAFLRSPTPWGDLYTSYGWPQVQTVLAVRSSQILEETSRPVMLAYQNFVNNTNTEAEYTANMSREMTNSSSNTWSNTHSLTFEQKIKYGINFGITAEGETTLSYEFSFGQSGTESVSTTLSTGAGVSVMVGPHRTKHVILSASEGRMRVRIRYEAYMTGSTAVNYNPRHRGHHFWGLGIAGVMRSGNISNTRTITEDISLQSYSNGRVLLEEGPAPISLVEEVTTLNEKATAPIPVIESTEPLEEEEEEKKE

SEQ ID NO: 228 - protein, 302 aa, Phlegmariurus nummularifolius
MSIQIDIEPGSVRVSGSSRHIITDGDVRTFGLNDNALKNAVLAHFERRPNDAFLRSPTPWGDLYTTYGWPQVQTVLAVRSSQILEETSRPVMLAYQNFVNNTNTEATYTANMSREVTNSSSNTWSNTHSLSFQQKIKYGINFGITAQGETTLSYKFSFGQSGTESVSTTISTGAGVSVVVAPHRTKHAILSASEGRMRVRIRYEAYLTGSTAVNYNPRHRGHHFWGLGTAGVMRSGDISNTRTITEDISLQSYSNGRVLLEEGPAPISLVEEVTTLNEKATAPIPVIESTEPLEEEEEEKKE

SEQ ID NO: 229 - protein, 302 aa, Phlegmariurus nummularifolius
MSIQIDIEPGSVRASGSSRHIITDGDVRTFGLNDNALKNAVLAHFERRPNDAFLRSPTPWGDLYTTYGWPQVQTVLAVRSSQILEETSRPVMLAYQNFVNNTNTEATYTANMSREVTNSSSNTWSNTHSLSFQQKIKYGINFGITAQGETTLSYKFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGRVLLEEGPAPISLVEEVTTLNEKATAPIPVIESTEPLEEEEEEKKE

SEQ ID NO: 230 - protein, 302 aa, Phlegmariurus nummularifolius
MSILIDIEPGNVRMSGSSRLIITDADVRTFGLNDNALKNAVLAHFERRPNDAFLRSPTPWGDLYTTYGWPQVQTVLAVRSSQILEETSRPVMLAYQNFVNNTNTEATYTANMSRAVTNSSSNAWSNSHSLSFQQKIKYGINFGITAQGETTLSYKFSFGQSGTESVSTTISTGAGVSVVVGPHRTKHAILSASEGRMRVRIRYEAYLTGSTAVNYNPRHRGHHFWGLGIAGVMRSGNISNTRTITEDISLLSYSNGSVVLGEGPAPLSLVEEVKTLNEKATAPIPVIESTEPLEEEEEENKE

SEQ ID NO: 231 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTANMSRAVTNSSSNAWSNSHSLSFQQKIKYGINFGITAQGETTLSYKFSFGQSGTESVSTTISTGAGVSVVVGPHRTKHAILSASEGRMRVRIRYEAYLTGSTAVNYNPRHRGHHFWGLGIAGVMRSGNISNTRTITEDISLLSYSNGSVVLGEGPAPLSLVEEVKTLNEKATAPIPVIESTEPLEEEEEENKE

SEQ ID NO: 232 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTANMSRAVTNSSSNAWSNSHSLSFQQKIKYGINFGITAQGETTLSYKFSFGQSGTESVSTTISTGAGVSVVVGPHRTKHAILSASEGRMRVRIRYEAYLTGSTAVNYNPRHRGHHFWGLGIAGVMRSGNISSTRTITEDISLLSYSNGSVVLGEGPAPLSLVEEVKTLNEKATAPIPVIESTEPLEEEEEENKE

SEQ ID NO: 233 - protein, 302 aa, Phlegmariurus nummularifolius
MSIQIDIEPGNVRVSGSSQHIITDADVRTFGLNDNALKNAVQAHFERRPNDAFLRSPTPWGDLYTSYGWPQVQTVLAVRSSQILEEASRPVMLAYQNFVNNTNTEAEYAANMSRGMTNSSSNTWSNTHSLTFEQKIKYGINFGITAEGETTLSYEFSFGQSGTESVSTTLSTGAGVSVMVGPHRTKHVILSASEGRMRVRIRYEAYMTGSTAVNYNPRHRGHHFWGLGIAGVMRSGNISNTRTITEDISLQSYSNGSVVLGEGPAPISLVEEVTTLNEKATAPIPVIESTEPLEEEEEEKKE

SEQ ID NO: 234 - protein, 302 aa, Phlegmariurus nummularifolius
MSIQIDIEPGNVRVSGSSQHIITDADVRTFGLNDNALKNAVQAHFERRPNDAFLRSPTPWGDLYTSYGWPQVQTVLAVRSSQILEETSRPVMLAYQNFVNNTNTEAEYTANMSREMTNSSSNTWSNTHSLTFEQKIKYGINFGITAEGETTLSYEFSFGQSGTESVSTTLSTGAGVSVMVGPHRTKHVILSASEGRMRVRIRYEAYMTGSTAVNYNPRHRGHHFWGLGIAGVMRSGNISNTRTITEDISLQSYSNGSVVLGEGPAPISLVEEVTTLNEKATAPIPVIESTEPLEEEEEEKKE

SEQ ID NO: 235 - protein, 302 aa, Phlegmariurus nummularifolius
MSIQIDIEPGNVRVSGSSRHIITDADVRTFGLNDNALKNAVQAHFERRPNDAFLRSPTPWGDLYTSYGWPQVQTVLAVRSSQILEETSRPVMLAYQTFVNNTNTEATYTANMSRVMRNSSSNAWSNTHSLSFRQKIKYGINFGITAQGETTLSYKFSFGQSGTESVSTTISTGAGVSVVVAPHRTKHAILSASEGRMRVRIRYEAYLTGSTAVNYNPRHRGHRFWGLGIAGVMRSGNISNTRTITEDISLQSYSNGRVVLEEGPAPISLVEEVTTLNEKATAPIPVIESTEPLEEEEEEKKE

SEQ ID NO: 236 - protein, 302 aa, Phlegmariurus nummularifolius
MSIQIDIEPGNVRVSGSSRHIITDADVRTFGLNDNALKNAVQAHFERRPNDAFLRSPTPWGDLYTSYGWPQVQTVLAVRSSQILEETSRPVMLAYQTFVNNTNTEATYTANMSRVMRNSSSNAWSNTHSLSFQQKIKYGINFGITAQGETTLSYKFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGRVVLEEGPAPISLVEEVTTLNEKATAPIPVIESTEPLEEEEEEKKE

SEQ ID NO: 237 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLDYRNFVNNTNTEATYTANMSRAMTNSSSNTWSNTHSLSFQQKITYGINFGITAQGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEEEKKE

SEQ ID NO: 238 - protein, 298 aa, Phlegmariurus nummularifolius
MSIQIDIEPGSVRVSGSSRHIITDGDVRTFGLNDNALKNAVLAHFERRPNDAFLRSPMPGDLYTTYGWPQVQTVLAVRSSQILEETSRPVMLDYQNFVNNTNTEATYPANMSRAVTTSLPNTWSNTHSLAFEQKIKYGINFGITAQGGTTLSYKFSFGQSWTESVSITISAVESVVVGPHQTKHAILSALEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEEEKD

SEQ ID NO: 239 - protein, 298 aa, Phlegmariurus nummularifolius
MSIQIDIEPGSVRVSGSSRHIITDGDVRTFGLNDNALKNAVLAHFERRPNDAFLRSPMPGDLYTTYGWPQVQTVLAVRSSQILEETSRPVMLDYQNFVNNTNTEATYPANMSRAVTTSLSNTWSNTHSLAFEQKIKYGINFGITAQGGTTLSYKFSFGQSWTESVSITISAVESVVVGPHQTKHAILSALEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEEEKD

SEQ ID NO: 240 - protein, 302 aa, Phlegmariurus nummularifolius
MSIQIDIEPGNVRVSGSSQHIITDADVRTFGLNDNALKNAVQAHFERRPNDAFLRSPTPWGDLYTSYGWPQVQTVLAVRSSQILEETSRPVMLAYQNFVNNTNTEATYTADMSRAMTNSSSNTWSNTHSLSFQQKITYGINFGITAEGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEEEKKE

SEQ ID NO: 241 - protein, 302 aa, Phlegmariurus nummularifolius
MSIQIDIEPGNVRVSGSSQHIITDADVRTFGLNDNALKNAVQAHFERRPNDAFLRSPTPWGDLYTSYGWPQVQTVLAVRSSQILEETSRPVMLAYQNFVNNTNTEATYTADMSRAMTNSSSNTWSNTHSLSFQQKITYGINFGITAEGETTLSYQFSFGQSRTESVSTTISTGAGVSVVVGPHRTKHAILSASEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEEEKKE

SEQ ID NO: 242 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLDYRNFVNNTNTEATYTANMSRSVTNSSSNTWSNTHSLAFEQKIKYGINFGITAEGETTLSYEFSFGQSGTESVSTTLSTGAGVSVMVGPHRTKHVILSASEGRMRVRIRYEAYMTGSTAVNYNPRHNGHHFWGLGIAGVMRSGNISNTRTITEDISLQSYSNSSVVLGEGPAPISLVEAVETLNEKATAPPPVVESIPMEEEEEEEKKE

SEQ ID NO: 243 - protein, 302 aa, Phlegmariurus nummularifolius
MSIQIDIEPGSVRVSGSSQHIITDADVRTFGLNDNALKNAVQAHFERRPNDAFLRSPTPWGDLYTSYGWPQVQTVLAVRSSQILEETSRPVMLAYQTFVNNTNTEATYTANMSRVMRNSSSNAWSNTHSLSFQQKIKYGINFGITAQGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGRVVLEEGPAPISLVEEVTTLNEKATAPIPVIESTEPLEEEEEEKKE

SEQ ID NO: 244 - protein, 302 aa, Phlegmariurus nummularifolius
MSIQIDIEPGSVRVSGSSRHIITDGDVRTFGLNDNALKNAVLAHFERRPNDAFLRSPTPWGDLYTTYGWPQVQTVLAVRSSQILEETSRPVMLAYQNFVNNTNTEATYTANMSREVTNSSSNTWSNTHSLTFEQKIKYGINFGITAEGETTLSYEFSFGQSGTESVSTTISTGAGVSVVVGPHRTKHAILSASEGRMRVRIRYEAYLTGSTAVNYNPRHRGHHFWGLGIAGVMRSGNISNTRTITEDISLLSYSNGSVVLGEGPAPLSLVEEVKTLNEKATAPIPVIESTEPLEEEEEEKKE

SEQ ID NO: 245 - protein, 301 aa, Phlegmariurus nummularifolius
MSIQIDIEPGNVRVSGSSQHIITDADVRTFGLNDNALKNAVQAHFERRPNDAFLRSPTPWGDLYTSYGWPQVQTVLAVRSSQILEETSRPVMLAYQTFVNNTNTEATYTANMSRVMRNSSSNAWSNTHSLSFQQKIKYGINFGITAEGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEEEKD

SEQ ID NO: 246 - protein, 301 aa, Phlegmariurus nummularifolius
MSIQIDIEPGNVRVSGSSQHIITDADVRTFGLNDNALKNAVQAHFERRPNDAFLRSPTPWGDLYTSYGWPQVQTVLAVRSSQILEETSRPVMLAYQTFVNNTNTEAAYTANMSRVMRNSSSNAWSNTHSLSFQQKIKYGINFGITAEGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEEEKD

SEQ ID NO: 247 - protein, 302 aa, Phlegmariurus nummularifolius
MSIQIDIEPGNVRVSGSSRHIITDADVRTFGLNNNALKNAVLAHFERRPNDAFLRSPTPWGDLYTTYGWPQVQTVLAVRSSQILEETSRPVMLAYQNFVNNTNTEATYTANMSRAMTNSSSNTWSNTHSLSFQQKIKYGINFGITAEGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSVVLGEGPAPISLVEEVTTLNEKATAPIPVIESTEPLEEEEEEKKE

SEQ ID NO: 248 - protein, 302 aa, Phlegmariurus nummularifolius
MSIQIDIQPGNVRVSGSSRHIITDADVRTFGLNDNALKNAVQAHFERRPNDAFLRSPTPWGDLYTSYGWPQVQTVLAVRSSQILEETSRPVMLAYQTFVNNTNTEATYTANMSRAMTNSSSNTWSNTHSLSFQQKIKYGINFGITAEGETTLSYQFSFGQSGTESVSTTISTGAEVSVVVGPHRTKHAILSASEGRMRVRIRYEAYLTGSTAVNYNPRHRGHHFWGLGIAGVMRSGNISNTRTITEDISLQSYSNGSVVLGEGPAPISLVEEVTTLNEKATAPIPVIESTEPLEEEEEEKKE

SEQ ID NO: 249 - protein, 302 aa, Phlegmariurus nummularifolius
MSIQIDIQPGNVRVSGSSRHIITDADVRTFGLNDNALKNAVQAHFERRPNDAFLRSPTPWGDLYTSYGWPQVQTVLAVRSSQILEETSRPVMLAYQTFVNNTNTEATYTANMSRAMTNSSSNTWSNTHSLSFQQKIKYGINFGITAEGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSVVLGEGPAPISLVEEVTTLNEKATAPIPVIESTEPLEEEEEEKKE

SEQ ID NO: 250 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTADMSRAMTNSSSNTWSNTHSLSFQQKITYGINFGITAEGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGRVVLGEGPAPLSLVEEVKTLNEKATAPIPVIESTEPLEEEEEEKKE

SEQ ID NO: 251 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTADMSRAMTNSSSNTWSNTHSLSFQQKITYGINFGITAEGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGSVVLGEGPAPLSLVEEVKTLNEKATAPIPVIESTEPSEEEEEEKKE

SEQ ID NO: 252 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTADMSRAMTNSSSNTWSNTHSLSFQQKITYGINFGITAEGETTLSYQFSFGQSGTESVSTTISTGAGVSVVVAPHRTKHAILSASEGRMRVRIRYEAYLTGSTAVNYNPRHRGHHFWGLGIAGVMRNGNISNTRTITEDISLQSYSNGSVVLGEGPAPLSLVEEVKTLNEKATAPIPVIESTEPLEEEEEEKKE

SEQ ID NO: 253 - protein, 302 aa, Phlegmariurus nummularifolius
MAFVIDIEPGNVRVSGSSRHIITDADVRTFGLNDNALKNAVQAHFERRPNDAFLRSPTPWGDLYTSYGWPQVQTVLAVRSSQILEETSRPVMLAYQNFVNNTNTEATYTANMSRAMTNSSSNTWSNTHSLSFQQKIKYGINFGITAEGETTLSYQFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSVVLGEGPAPISLVEEVKTLNEKATAPIPVIESTEPLEEEEEEKKE

SEQ ID NO: 254 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNSNTEATYTANMSRAVTNSSSNTWSNTHSLAFEQKIKYGINFGITAEGETTLSYEFSFGQSGTESVSTTISTGAGVSVVVGPHRTKHAILSASEGRMRVRIRYEAYLTGSTAVNYNPRHRGHHFWGLGIAGVMRSGNISNTRTITEDISLLSYSNGSVVLGEGPAPLSLVEEVKTLNEKATAPIPVIGSTEPLEEEEEEKKE

SEQ ID NO: 255 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNSNTEATYTANMSRAVTNSSSNTWSNTHSLAFEQKIKYGINFGITAEGETTLSYEFSFGQSGTESVSTTISTGAGVSVVVGPHRTKHAILSASEGRMRVRIRYEAYLTGSTAVNYNPRHRGHHFWGLGIAGVMRSGNISNTRTITEDISLLSYSNGSVVLGEGPAPLSLVEEVKTLNEKATAPIPVIESTEPLEEEEEEKKE

SEQ ID NO: 256 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNSNTEATYTANMSRAVTNSSSNTWSNTHSLAFEQKIKYGINFGITAEGETTLSYEFSFGQSGTESVSTTISTGAGVSVVVGPHRTKHAILSASEGRMRVRIRYEAYLTGSTAVNYNPRHRGHHFWGSGIAGVMRSGNISNTRTITEDISLLSYSNGSVVLGEGPAPLSLVEEVKTLNEKATAPIPVIESTEPLEEEEEEKKE

SEQ ID NO: 257 - protein, 302 aa, Phlegmariurus nummularifolius
MSIQIDIEPGNVRVSGSSRHIITDADVRTFGLNDNALKNAVLAHFERRPNDAFLRSPTPWGDLYTTYGWPQVQTVLAVRSSQILEETSRPVMLAYQNFVNNTNTEATYTANMSREVTNSSSNTWSNTHSLTFEQKIKYGINFGITAEGETTLSYEFSFGQSGTESVSTTISTGAGVSVVVGPHRTKHAILSASEGRMRVRIRYEAYLTGSTAVNYNPRHRGHHFWGLGIAGVMRSGNISNTRTITEDISLQSYSNGSIVLGEGPAPISLVEEVKTLNEKATAPIPVIESTEPLEEEEEEKKE

SEQ ID NO: 258 - protein, 302 aa, Phlegmariurus nummularifolius
MSIQIDIEPGNVRVSGSSRHIITDADVRTFGLNDNALKNAVQAHFERRPNDAFLRSPTPWGDLYTSYGWPQVQTVLAVRSSQILEETSRPVMLAYQNFVDNTNTEATYTANMSRAVTNSSSNTWSNTHSLAFEQEIKYGINFGITAQGETTLSYEFSFGQSGTESVSTKISTGAGVSVVVGPHRTKHAILSASEGRMRVRIRYEAYLTGSTAVNYNPRHRGHHFWGLGIAGVMRSGNISNTRTITEDISLLSYSNGSVVLGEGPAPLSLVEEVKTLNEKATAPIPVIESTEPLEEEEEEKKE

SEQ ID NO: 259 - protein, 302 aa, Phlegmariurus nummularifolius
MSIQIDIEPGNVRVSGSSRHIITDADVRTFGLNDNALKNAVQAHFERRPNDAFLRSPTPWGDLYTSYGWPQVQTVLAVRSSQILEETSRPVMLAYQNFVNNTNTEATYTANMSRAVTNSSSNTWSNTHSLAFEQKIKYGISFGITAQGETTLSYEFSFGQSGTESVSTKISTGAGVSVVVGPHRTKHAILSASEGRMRVRIRYEAYLTGSTAVNYNPRHRGHHFWGLGIAGVMRSGNISNTRTITEDISLLSYSNGSVVLGEGPAPLSLVDEVKTLNEKATAPIPVLESTEPLEEEEEDKKE

SEQ ID NO: 260 - protein, 302 aa, Phlegmariurus nummularifolius
MSIQIDIEPGNVRVSGSSRHIITDADVRTFGLNDNALKNAVQAHFERRPNDAFLRSPTPWGDLYTSYGWPQVQTVLAVRSSQILEETSRPVMLAYQNFVNNTNTEATYTANMSRAVTNSSSNTWSNTHSLAFEQKIKYGINFGITAQGETTLSYEFSFGQSGTESVSTKISTGAGVSVVVGPHRTKHAILSASEGRMRVRIRYEAYLTGSTAVNYNPRHRGHHFWGLGIAGVMRSGNISNTRTITEDISLLSYSNGSVVLGEGPAPLSLVEEVKTLNEKATAPIPVIESTEPLEEEEEEKKE

SEQ ID NO: 261 - protein, 247 aa, Huperzia phlegmaria
MSIQIDIEPGRVRVSGSSRHIITDADVRTFGLNDNALKNAVLAHLGRRPNDAFLRSPTPWGDLYSTYGWPQVQTVLAVRSSQILEETTRPVMLAYQNFVNNTNTEATYTANMSREMTNSSSNTWSNTHSLSFEQKIKYGINFGITAVGETTLSYEFSFGQSGTESVSTTLSTGAGVSVVVGPQRTKHAILSASEGRMRVRIRYEAYLTGSTAVNYNPRHNGHHFWGLGIAGVMRSGNISNTRTITGS

SEQ ID NO: 262 - protein, 247 aa, Huperzia phlegmaria
MSIQIDIEPGTVRVSGSSRHIITDADVRTFGLNDNALKNAVLAHLGRRPNDAFLRSPTPWGDLYSTYGWPQVQTVLAVRSSQILEETSRPVMLAYQNFVNNTNTEATYTANMSREMTNSSSNTWSNTHSLSFEQKIKYGINFGITAVGETTLSYEFSFGQSGTESVSTTLSTGAGVSVVVGPQRTKHAILSASEGRMRVRIQYEAYLTGSTAVNYNPRHNGHHFWGLGIAGVMRSGNISNTRTITGS

SEQ ID NO: 263 - protein, 247 aa, Huperzia phlegmaria
MSIQIDIEPGSVRVSGSSRHIITDADVRTFGLNDNALKNAVLAHFGRRPNDAFLRSPTPWGDLYSTYGWPQVQTVLAVRSSQILEETTRPVMLAYQNFVNNTNTEATYTANMSREMTNSSSNTWSNTHSLSFEQKIKYGINFGITAVGETTLSYEFSFGQSGTESVSTTLSSGAGVSVVVGPHQTKHAILSASEGRMRVRIRYEAYLTGSTAVNYNPRHNGHHFWGLGIAGVMRSGNISNTRTITGS

SEQ ID NO: 264 - protein, 247 aa, Huperzia phlegmaria
MSIQIDIEPGSVRVSGSSRHIITDADVRTFGLNDNALKNAVLAHLGRRPNDAFLRSPTPWGDLYSTYGWPQVQTVLAVRSSQILEETTRPVMLAYQNFVNNTNTEATYTANMSREMTNSSSNTWSNTHSLSFEQKIKYGINFGITAVGETTLSYEFSFGQSGTESVSTTLSTGAGVSVVVGPQRTKHAILSASEGRMRVRIRYEAYLTGSTAVNYNPRHNGHHFWGLGIAGVMRSGNISNTRTITGS

SEQ ID NO: 265 - protein, 247 aa, Huperzia phlegmaria
MSIQIDIEPGNVRVSGSSWHIITDADVRTFGLNDNALKNAVLAHFGRRPNDAFLRSPTPWGDLYTTYGWPQVQTVLAVRSSQILEETTRPVMLAYQNFVNNTNTEATYTANMSREMTNSSSNTWSNTHSLSFEQKIKYGINFGITAVGETTLSYEFSFGQSGTESVSTTLSTGAGVSVVVGPQRTKHAILSASEGRMRVRIRYEAYLTGSTAVNYNPRHNGHHFWGLGIAGVMRSGNISNTRTITGS

SEQ ID NO: 266 - protein, 247 aa, Huperzia phlegmaria
MSIQIDIEPGSVRVSGSSRHIITDADVRTFGLNDNALKNAVLAHFGRRPNDAFLRSPTPWGDLYTTYGWPQVQTVLAVRSSQILEESSRPVMLAYQNFVNNTNTEATYTANMSREMTNSSSNTWSNTHSLSFEQKIKYGINFGITAVGETTLSYEFSFGQSGTESVSTTLSTGAGVSVVVGPQRTKHAILSASEGRMRVRIQYEAYLTGSTAVNYNPRHNGHHFWGLGIAGVMRSGNISNTRTITGS

SEQ ID NO: 267 - protein, 247 aa, Huperzia phlegmaria
MSIQIDIEPGNVRVSGSSRHIITDADVRTFGLNDNALKNAVLAHLGRRPNDAFLRSPTPWGDLYSTYGWPQVQTVLAVRSSQILEETSRPVMLAYQNFVNNTNTEATYTASMSRAVTNSSSNTWSNTHSLTFEQKIKYGINFGITAEGETTLSYEFSFGQSGTESVSTTLSTGAGVSVVVAPHRTKHAILSASEGRMRVRIRYEAYLTGSTAVNYNPRHNGHHFWGLGIAGVMRSGNISNTRTITGS

SEQ ID NO: 268 - protein, 247 aa, Huperzia phlegmaria; identical to SEQ ID NO: 264

SEQ ID NO: 269 - protein, 247 aa, Huperzia phlegmaria
MSIQIDIEPGSVRVSGSSRHIITDADVRTFGLNDNALKNAVLAHFGRRPNDAFLRSPTPWGDLYSTYGWPQVQTVLAVRSSQILEETSRPVMLAYQNFVNNTNTEATYTANMSRVVTNSSSNTWSNTHSFTFEQKIKYGINFGITAVGETTLSYEFSFGQSGTESVSTTLSTGAGVSVVVGPQRTKHAILSASEGRMRVRIRYEAYLTGSTAVNYNPRHNGHHFWGLGIAGVMRSGNISNTRTITGS

SEQ ID NO: 270 - protein, 247 aa, Huperzia phlegmaria
MSIQIDIEPGSVRVSGSSRHIITDADVRTFGLNDNALKNAVLAHFGRRPNDAFLRSPTPWGDLYTTYGWPQVQTVLAVRSSQILEETSRPVMLAYQNFVNNTNTEATYTASMSRAVTNSSSNTWSNTHSLTFEQKIKYGINFGITAEGETTLSYEFSFGQSGTESVSTTLSTGAGVSVVVGPQRTKHAILSASEGRMRVRIRYEAYLTGSTAVNYNPRHNGHHFWGLGIAGVMRSGNISNTRTITGS

SEQ ID NO: 271 - protein, 247 aa, Huperzia phlegmaria
MSIQIDIEPGSVRVSGSSRHIITDADVRTFGLNDNALKNAVLAHFGRRPNDAFLRSPTPWGDLYTTYGWPQVQTVLAVRSSQILEESSRPVMLAYQNFVNNTNTEATYTASMSRAVTNSSSNTWSNTHSLTFEQKIKYGINFGITAEGETTLSYEFSFGQSGTESVSTTLSTGAGVSVVVAPHRTKHAILSASEGRMRVRIRYEAYLTGSTPVNYNPRHDGHHFWGLGIAGVMRSGNISNTRTITGS

SEQ ID NO: 272 - protein, 247 aa, Huperzia phlegmaria
MSIQIDIEPGSVRVSGSSRHIITDADVRTFGLNDNALKNAVLAHFGRRPNDAFLRSPTPWGDLYTTYGWPQVQTVLAVRSSQILEESSRPVMLAYQNFVNNTNTEATYTASMSRAVTNSSSNTWSNTHSLTFEQKIKYGINFGITAEGETTLSYEFSFGQSGTESVSTTLSTGAGVSVVVAPHRTKHAILSASEGRMRVRIRYEAYLTGSTAVNYNPRHNGHHFWGLGIAGVMRSGNISNTRTITGS

SEQ ID NO: 273 - protein, 302 aa, Phlegmariurus nummularifolius
MAFVIDIEPGNVRVSGSSQHIITDADVRTFGLNDNALKNAVQAHFERRPNDAFLRSPTPWGDLYTSYGWPQVQTVLAVRSSQILEETSRPVMLAYQTFVNNTNTEATYTANMSRVMRNSSSNAWSNTHSLSFQQKIKYGINFGITAQGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGRVLLEEGPAPISLVEEVTTLNEKATAPIPVIESTEPLEEEEEEKKE

SEQ ID NO: 274 - protein, 300 aa, Phlegmariurus nummularifolius
MSIQIDIEPGNVQVSGSSRHIITDADVRTFGLNDNALKNAVLAHFERRPNDAFLRSPTPWGDLYTTYGWPQVQTVLAVRSSQILEETSRPVMLDYQNFVNNTNTEATYPANMSRAVTTSLSNTWSNTHSLAFEQKIKYGINFGITAQGGTTLSYKFSFGQSWTESVSITISAVASVVVGPHQTKHAILSALEGRMRVRIRYEAYLTGSTAVNYNPRHRGHHFWGLGIDGVMRSGNISNTRTITEDISLHSYSNGSVVFGEGPAPLSLVEEVKTLNEKATTPIPVIESTEPLEEEEEEKKE

SEQ ID NO: 275 - protein, 302 aa, Phlegmariurus nummularifolius
MAFVINIEPGNVRVSGSSQHIITDADVRTFGLNDNALKNAVQAHFERRPNDAFLRSPTPWGDLYTSYGWPQVQTVLAVRSSQILEETSRPVMLAYQTFVNNTNTEATYTANMSRVMRNSSSNAWSNTHSLSFQQKIKYGINFGITAQGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGRVLLEEGPAPISLVEEVTTLNEKATAPIPVIESTEPLEEEEEEKKE

SEQ ID NO: 276 - protein, 302 aa, Phlegmariurus nummularifolius
MAFLIDIEPGNVRVSGSSQHIITDADVRTFGLNDNALKNAVQAHFERRPNDAFLRSPTPWGDLYTSYGWPQVQTVLAVRSSQILEETSRPVMLAYQTFVNNTNTEATYTANMSRVMRNSSSNAWSNTHSLSFQQKIKYGINFGITAQGETTLSYQFSFGQSGTESVSTTISTGAGVSVVVAPHRTKHAILSASEGRMRVRIRYEAYLTGSTAVNYNPRHRGHHFWGLGIAGVMRSGNISNTRTITEDISLQSYSNGRVLLEEGPAPISLVEEVTTLNEKATAPIPVIESTEPLEEEEEEKKE

SEQ ID NO: 277 - protein, 300 aa, Phlegmariurus nummularifolius
MSIQIDIEPGNVRVSGSSRHIITDADVRTFGLNDNALKNAVLAHFERRPNDAFLRSPMPWGDLYTTYGWPQVQTVLAVRSSQILEETSRPVMLDYQNFVNNTNTEATYPANMSRAVTTSLSNTWSNTHSLAFEQKIKYGISFGITAQGGTTLSYKFSFGQSWTESVSITISAVASVVVGPHQTKHAILSALEGQMRVRIRYEAYLTGSTAVNYNPRHRGHHFWGLGIDGVMRSGNISNTRTITEDISLHSYSNGSVVFGEGPAPLSLVEEVKTLNEKATTPIPVIESTEPLEEEEEEKKE

SEQ ID NO: 278 - protein, 285 aa, Huperzia phlegmaria
MSIEIDIEPGRVRVSGSSRHIITDADVGTFGLHDNALKNAVLAHFGRRPNDAFLRSPTPWNDLYTSYGWAQVQTVLVVRSSTILEESSRPAMLAYQNFINNTSTEATYTAEMSRAMTNSSSNTWSNTHNIRFEQTITYKINFGITAGGETSMGYEFSFGQSGTTETSTTISSGAAVSVVVGPHRTKHAILSASEGRMRVRITYEVYLTGSTAVNYNPRHNGHHFWGLGIAGVMRSGNISSTRTITEDITLQSYSNGSIVLGEGPAPSPVVEEVETLEKEKEKKGS

SEQ ID NO: 279 - protein, 285 aa, Huperzia phlegmaria
MSIEIDIEPGRVWVSGSSRHIITDADVGTFGLHDNALKNAVLAHFGRRPNDAFLRSPTPWNDLYTSYGWAQVQTVLVVRSSTILEESSRPAMLAYQNFINNTSTEATYTAEMSRAMTNSSSNTWSNTHNIRFEQTITYKINFGITAGGETSMGYEFSFGQSGTTETSTTISSGAAVSVVVGPHRTKHAILSASEGRMRVRITYEVYLTGSTAVNYNPRHNGHHFWGLGIAGVMRSGNISSTRTITEDITLQSYSNGSIVLGEGPAPSPVVEEVETLEKEKEKKGS

SEQ ID NO: 280 - protein, 285 aa, Huperzia phlegmaria
MSIEIDIEPGRVRVSGSSRHIITDADVGTFGLHDNALKNAVLAHFGRRPNDAFLRSPTPWNDLYTSYGWAQVQTVLVVRSSTILEESSRPAMLAYQNFINNTSTEATYTAEMSRAMTNSSSNTWSNTHNIRFEQTITYKINFGITAGGETSMGYEFSFGQSGTNETSTTISSGAAVSVVVGPHRTKHAILSASEGRMRVRITYEVYLTGSTAVNYNPRHNGHHFWGLGIAGVMRSGNISSTRTITEDITLQSYSNGSIVLGEGPAPSPVVEEVEKLEKEKEKKGS

SEQ ID NO: 281 - protein, 285 aa, Huperzia phlegmaria
MSIEIDIEPGRVRVSGSSRHIITDADVGTFGLHDNALKNAVLAHFGRRPNDAFLRSPTPWNDLYTSYGWAQVQTVLVVRSSTILEESSRPAMLAYQNFINNTSTEATYTAEMSRAMTNSSSNTWSNTHNIRFEQTITYKINFGITAGGETSMGYEFSFGQSGTTETSTTISSGAAVSVVVGPHRTKHAILSASEGRMRVRITYEVYLTGSTAVNYNPRHNGHHFWGLGIAGVMRSGNISSTRTITEDITLQSYSNGSIVLGEGPAPSPGVEEIETLEKEKEKKGS

SEQ ID NO: 282 - protein, 285 aa, Huperzia phlegmaria; identical to SEQ ID NO: 280

SEQ ID NO: 283 - protein, 291 aa, Huperzia carinata Philipines
MSIEIDIEPGSVRVSGSSRHIITDADVGTFGLHDNALKNAVLAHNGRRPNDAFLRSPTPWNDLYTTYGWAQVQTVLVVRSSTILEESSRPTSLAYQNFVNNTSSEATYTAHLSREMTNSSSNTWSNTHSIRFEQTITYKINFGITAGGETSFGYESSFGQSGTHETSTTISSGASVSVVVGPHRTKHAILSASEGRMRVRITYEVYLTGSTAVNYNPRHNGHHFWGLGISGVMRSGNISNTRTITEDVTLQSYSNGSIVLGEGPAPSAVVEAVETLEKEQEKEKEKEKKGS

SEQ ID NO: 284 - protein, 289 aa, Huperzia carinata Philipines
MSIEIDIEPGSVRVSGSSRHIITDADVGTFGLHDDALKNAVLAHNGRRPNDAFLRSPTSWNDLYTTYGWAQVQTVLVVRSSTILEQSSRPTALAYQNFINNTSTEATYTAQLSREMTNSSSNTWSNTHSIRFEQTITYKINFGITAGGETSLGYESSFGQSGTHETSTTISSGASVSVVVGPHRTKHAILSASEGRMRVRITYEVYLTGSTAVNYNPRHNGHHFWGLGISGVMRSGNISNTRTITEDVTLQSYSNGSIVLGEGPAPSPVVEAVETLEKEKEKEKEKKGS

SEQ ID NO: 285 - protein, 289 aa, Huperzia carinata Philipines
MSIEIDIEPGSVRVSGSSRHIITDADVGTFGLHDNALKNAVLAHNGRRPNDAFLRSPTPWNDLYTTYGWAQVQTVLVVRSSTILEESSRPTSLAYQNFVNNTSSEATYTAHLSREMTNSSSNTWSNTHSIRFEQTITYKINFGITAGGETSFGYESSFGQSGTHETSTTISSGASVSVVVGPHRTKHAILSASEGRMRVRITYEVYLTGSTAVNYNPRHNGHHFWGLGISGVMRSGNISNTRTITEDVTLQSYSNGSIVLGEGPAPSAVVEAVETLEKEQEKEKEKKGS

SEQ ID NO: 286 - protein, 295 aa, Huperzia carinata Philipines
MSIEIDIEPGSVRVSGSSRHIITDADVGTFGLHDNALKNAVLAHNGRRPNDAFLRSPTPWNDLYTTYGWAQVQTVLVVRSSTILEESSRPTSLAYQNFVNNTSSEATYTAHLSREMTNSSSNTWSNTHSIRFEQTITYKINFGITAGGETSFGYESSFGQSGTHETSTTISSGASVSVVVGPHRTKHAILSASEGRMRVRITYEVYLTGSTAVNYNPRHNGHHFWGLGISGVMRSGNISNTRTITEDVTLQSYSNGSIVLGEGPAPSAVVEAVETLEKEQEKEKEKEKEKEKKGS

SEQ ID NO: 287 - protein, 289 aa, Huperzia carinata Philipines
MSIEIDIEPGSVRVSGSSRHIITDADVGTFGLHDNALKNAVLAHNGRRPNDAFLRSPTPWNDLYTTYGWAQVQTVLVVRSSTILEQSSRPTALAYQNFINNTSTEATYTAQLSREMTNSSSNTWSNTHSIRFEQTITYKINFGITAGGETSLGYESSFGQSGTHETSTTISSGASVSVVVGPHRTKHAILSASEGRMRVRITYEVYLTGSTAVNYNPRHNGHHFWGLGISGVMRSGNISNTRTITEDVTLQSYSNGSIVLGEGPAPSAVVEAVETLEKEKEREREKKGS

SEQ ID NO: 288 - protein, 275 aa, Huperzia goebelii
MAFVVQVKHGRVNATGNSEHVITDADVRSFGIHDSALKDAVTKHFGRWPTDAYLKSPTPWNDLYKTYGWPQVQTVLKVQSSSITEATSKPVIVAYQNFVNNSNEEATYTANMSRQKTNSASHTWSNQHTLKIEQKIKYEINFGVNVGGETTLSYQYAFGESGTKTVSTTISSGSAVTVKVGPHQTKHAILRASEGQMKVRIVYEAHLKGSTAVNYNPTYKGHHFYGLDIAAVMSAGGISSRKTITEDVVLDYFAQSSVVVGDGPAPSSVLAAVAK

SEQ ID NO: 289 - protein, 275 aa, Huperzia goebelii
MAFVVQVKNGRVNATGNSEHVITDADVRSFGIHDSALKDAVTKHFGRWPTDAYLKSPTPWNDLYKTYGWPQVQTVLKVQSSSITEATSKPVIVAYQNFVNNSNEEATYTANMSRQKTNSASHTWSNQHTLKIEQKIKYEINFGVNVGGESTLSYQYAFGESGTKTVSTTISSGSAVTVKVGPHQTKHAILRASEGQMKVRIVYEAHLKGSTAVNYNPTYKGHHFYGLDIAAVMSAGGISSRKTITEDVVLDYFAQSSVVVGDGPAPSSVLAAVAK

SEQ ID NO: 290 - protein, 275 aa, Huperzia goebelii
MAFVVQVKNGRVNATGNSEHVITDADVRSFGIHDSALKDAVTKHFGRWPTDAYLKSPTPWNDLYKTYGWPQVQTVLNVQSSSITEATSKPVIVAYQNFVNNSNEESTYTANMSRQKTNSASHTWSNQHTLKIEQKIKYEINFGVNVGGETTLSYQYAFGESGTKTVSTTISSGSAVTVKVGPHQTKHAILRASEGQMKVRIVYEAHLKGSTAVNYNPTYKGHHFYGLDIAAVMSAGGISSRKTITEDVVLDYFAQSSVVVGDGPAPSSVLAAVAK

SEQ ID NO: 291 - protein, 275 aa, Huperzia goebelii
MAFVVQVKNGRVNATGNSEHVITDADVRSFGIHDSALKDAVTKHFGRWPTDAYLKSPTPWNDLYKTYGWPQVQTVLKVQSSSITEATSKPVIVAYQNFVNNSNEEATYTANMSRQKTNSASHTWSNQHTLKIEQKIKYEINFGVNVGGESTLSYQYAFGESGTKTVSTTISSGSAVTVKAGPHQTKHAILRASEGQMKVRIVYEAHLKGSTAVNYNPTYKGHHFYGLDIAAVMSAGGISSRKTITEDVVLDYFAQSSVVVGDGPAPSSVLAAVAK

SEQ ID NO: 292 - protein, 275 aa, Huperzia goebelii
MAFVVQVKNGRVNATGNSEHVITDADVKSFGIHDSALKDAVTKHFGRWPTDAYLKSPTPWNDLYKTYGWPQVQTVLNVQSSSITEATSKPVIVAYQNFVNNSNEESTYTANMSRQKTNSASHTWSNQHTLKIEQKIKYEINFGVNVGGETTLSYQYAFGESGTKTVSTTISSGSAVTVKVGPHQTKHAILRASEGQMKVRIVYEAHLKGSTAVNYNPTYKGHHFYGLDIAAVMSAGGISSRKTITEDVVLDYFAQSSVVVGDGPAPSSVLAAVAK

SEQ ID NO: 293 - protein, 275 aa, Huperzia goebelii
MAFVIAIKPGNVNATGNSQHVITDADVKSFGIHDSALKDAVTKHFGRWPTDAYLKSPTPWNDLYKTYGWPQVQTVLNVQSSSITEATSKPVIVAYQNFVNNSNEESTYTANMSRQKTDSASHTWSSQHTLKVDQKIKYEINFGVNVGGETTLSYQYAFGESGTKTTTTTLSSGSGVKVNVGPHRTKHAILRASQGQMKVRIVYVAHLTGSIAVNYDPTYKGHHFYSLDIGVVMSKGGISSSKTITEDIVLDYYSHSTVEVGDGPAPSSVVLAVAK

SEQ ID NO: 294 - protein, 275 aa, Huperzia goebelii
MAFVVQVKNGRVNATGNSEHVITDADVKSFGIHDSALKDAVTKHFGRWPTDAYLKSPTPWNDLYKTYGWPQVQTVLKVQSSSITEATSKPVIVAYQNFVNNSNEEATYTANMSRQKTNSASHTWSNQHTLKIEQKIKYEINFGVNVGGESTLSYQYAFGESGTKTVSTTISSGSAVTVKAGPHQTKHAILRASEGQMKVRIVYEAHLKGSTAVNYNPTYKGHHFYGLDIAAVMSAGGISSRKTITEDVVLDYFAQSSVVVGDGPAPSSVLAAVAK

SEQ ID NO: 295 - protein, 275 aa, Huperzia goebelii
MAFVVQVKNGRVNATGNSEHVITDADVKSFGIHDSALKDAVTKHFGRWPTDAYLKSPTPWNDLYKTYGWPQVQTVLNVQSSSITEATSKPVIVAYQNFVNNSNEESTYTANMSRQKTNSASHTWSNQHTLKIEQKIKYEINFGVNVGGESTLSYRYAFGESGTKTVSTTISSGSAVTVKVGPHQTKHAILRASEGQMKVRIVYEAHLKGSTAVNYNPTYKGHHFYGLDIAAVMSAGGISSRKTITEDVVLDYFAQSSVVVGDGPAPSSVLAAVAK

SEQ ID NO: 296 - protein, 275 aa, Huperzia carinata
MAFVIKVKPGKVNATGNSRHVITDADVNSFGIHDSALKDAVTKYFGRWPTDAYLKSPTPWNDLYKTYGWPQVQTVLKVQSSSITEASSKLVILQYQNFVNKSNEDATYTANMSRQKTNSASHTWSNQHTLKIEQKIKYEINFGVNVGGETTLSYQYAFGESGTKTTTTTLSSGSGVTVKVGPHKTKHAILRASEGQMKVRIVYVANLTGSTAVNYYPTYKGHHFYSLDIAGVMSAGGICSSKTITEDVVLDYYSHSTVEVGDGPAPSSVLAAVAE

SEQ ID NO: 297 - protein, 275 aa, Huperzia carinata
MAFVIKVKPGKVNASGNSQHVITDADVKSFGIHDSALKDAVTKYFGRWPTDAYLKSPTPWNDLYKTYGWPQVQTVLKVQSSSITEATSKPVILDYQNFVNKSSEEATYTANMSRQKTNSASHTWSNQHTFKIDQKIKYEINFGANGGGETTLSYQYAFGESETKTTTTTLSSGSGVTVKVGPHKTKHAILRASEGQMKVRIVYAAHLTGSTAVNYYPTYKGHHFYSLDIAGVMSAGGICSSKTITEDVVLDYYSHSTVEVGDGPAPSSVLAAVAE

SEQ ID NO: 298 - protein, 277 aa, Huperzia phlegmaria
MAFVIKVKPGNVNATGNSQHVITDADVKSFGIHDSALKDAVTKYFGRWPTDAYLKSPTPWNDLYKTYGWPQVQIVLKVQSSSITEASSKPVILQYQNFINKSNEEATYTANMSRQKTNSASHTWSNQHTLKVEQKIKYEINFGVNVGGETTLSYQYAFGESGTKTTTTTLSSGSGVTVKVGPHKTKHAILRASEGQMKVRIVYVAHLTGSTAVNYYPTYKGHHFYSLDIAGVMSAGGISSSKTITEDVVLDYYSHSTVEVGDGPAPSSVSAAVAKGS

SEQ ID NO: 299 - protein, 277 aa, Huperzia phlegmaria
MAFVIKVKPGNVNATGNSQHVITDADVKSFGIHDSALKDAVTKYFGRWPTDAYLKSPTPWNDLYKTYGWPQVQIVLKVQSSSITEASSKPVILQYQNFINKSNEEATYTANMSRQKTNSASHTWSNQHTLKVEQKIKYEINFGVNVGGETTLSYQYAFGESGRKTTTTTLSSGSGVTAKVGPHKTKHAILRASEGQMKVRIVYVAHLTGSTAVNYYPTYKGHHFYSLDIAGVMSAGGISSSKTITEDVVLDYYSHSTVEVGDGPAPSSVSAAVAKGS

SEQ ID NO: 300 - protein, 277 aa, Huperzia phlegmaria
MAFVIKVKPGNVNATGNSQHVITDADVKSFGIHDSALKDAVTKYFGRWPTDAYLKSPTPWNDLYKTYGWPQVQIVLKVQSSSITEASSKPVILQYQNFINKSNEEATYTANMSRQKTNSASHTWSNQHTLKVEQKIKYEINFGVNVGGETTLSYQYAFGESGRKTTTTTLSSGSGVTVKVGPHKTKHAILRASEGQMKVRIVYVAHLTGSTAVNYYPTYKGHHFYSLDIAGVMSAGGISSSKTITEDVVLDYYSHSTVEVGDGPAPSSVSAAVAKGS

SEQ ID NO: 301 - protein, 277 aa, Huperzia phlegmaria
MAFVIKVKPGNVNATGNSQHVITDADVKSFGIHDSALKGAVTKYFGRWPTDAYLKSPTPWNDLYRTYGWPQVQIVLKVQSSSITEASSKPVILQYQNFINKSNEEATYTANMSRQKNNSASHTWSNQHTLKVEQKIKYEINFGVNVGGETTLSYQYAFGESGTKTTTTTLSSGSGVTVKVGPHKTKHAILRASEGQMKVRIVYVAHLTGSTAVNYYPTYKGHHFYSLDIAGVMSAGGISSSKTITEDVVLDYYSHSTVEVGDGPAPSSVSAAVAKGS

SEQ ID NO: 302 - protein, 277 aa, Huperzia phlegmaria
MAFVIKVKPGNVNATGNSQHVITDADVKSFGIHDSALKDAVTKYFGRWPTDAYLKSPTPWNDLYKTYGWPQVQIVLKVQGSSITEASSKPVILQYQNFINKSNEEATYTANMSRQKNNSASHTWSNQHTLKVEQKIKYEINFGVNVGGETTLSYQYAFGESGTKTTTTTLSSGSGVTVKVGPHKTKHAILRASEGQMKVRIVYVAHLTGSTAVNYYPTYKGHHFYSLDIAGVMSAGGISSSKTITEDVVLDYYSHSTVEVGDGPAPSSVSAAVAKGS

SEQ ID NO: 303 - protein, 277 aa, Huperzia phlegmaria
MAFVIKVKPGNVNATGNSQHVITDADVKSFGIHDSALKDAVTKYFGRWPTDAYLKSPTPWNDLYKTYGWPQVQIVLKVQSSSITEASSKPVILQYQNFINKSNEEATYTANMSRQKNNSASHTWSNQHTLKVEQKIKYEINFGVNVGGETTLSYQYAFGESGTKTTTTTLSSGSGVTVKVGPHKTKHAILRASEGQMKVRIVYVAHLTGSTAVNYYPTYKGHHFYSLDIAGVMSAGGISSSKTITEDVVLDYYSHSTVEVGDGPAPSSVSAAVAKGS

SEQ ID NO: 304 - protein, 277 aa, Huperzia phlegmaria
MAFVIKVKPGNVNATGNSQHVITDADVKSFGIHDSALKDAVTKYFGRWPTDAYLKSPTPWNDLYKTYGWPQVQIVLKVQSSSITEASSKPVILQYQNFINKSNEEATYTANMSRQKTNSASHTWSNQHTLKVEQKIKYEINFGVNVGGETTLSYQYAFGESGTKTTTTTLSSGSGVTVKVGPHKTKHAILRASEGQMKVRIVYVAHLTGSTAVNYYPTYKGHHFYSLDIAGVMSAGGISSSKTITEDVVLDYYSHSTVEVGDGPAPLSVSAAVAKGS

SEQ ID NO: 305 - protein, 277 aa, Huperzia phlegmaria
MAFVIKVKPGNVNATGNSQHVITDADVKSFGIHDSALKDAVTKYFGRWPTDAYLKSPTPWNDLYKTYGWPQVQIVLKVQSSSITEASSKPVILQYQNFINKSNEEATYTANMSRQKTNSASHTWSNQHTLKVEQKIKYEINFGVNVGGETTLSYQYAFGESGTKTTTTALSSGSGVTVKVGPHKTKHAILRASEGQMKVRIVYVAHLTGSTAVNYYPTYKGHHFYSLDIAGVMSAGGISSSKTITEDVVLDYYSHSTVEVGDGPAPLSVSAAVAKGS

SEQ ID NO: 306 - protein, 277 aa, Huperzia phlegmaria
MAFVIKVKPGNVNATGNSQHVITDADVKSFGIHDSALKDAVTKYFGRWPTDAYLKSPTPWNDLYKTYGWPQVQIVLKVQSSSITEASSKPVILQYQNFINKSNEEATYTANMSRQKNNSASHTWSNQHTLKVEQKIKYEINFGVNVGGETTLSYQYAFGESGRKTTTTTLSSGSGVTVKVGPHKTKHAILRASEGQMKVRIVYVAHLTGSTAVNYYPTYKGHHFYSLYIAGVMSAGGISSSKTITEDVVLDYYSHSTVEVGDGPAPSSVSAAVAKGS

SEQ ID NO: 307 - protein, 277 aa, Huperzia phlegmaria
MAFVIKVKPGNVNATGNSQHVITDADVKSFGIHDSALKDAVTKYFGRWPTDAYLKSPTPWNDLYKTYGWPQVQIVLKVQSSSITEASSKPVILQYQNFINKSNEEATYTANMSRQKNNSASHTWSNQHTLKVEQKIKCEINFGVNVGGETTLSYQYAFGESGRKTTTTTLSSGSGVTVKVGPHKTKHAILRASEGQMKVRTVYVAHLTGSTAVNYYPTYKGHHFYSLDIAGVMSAGGISSSKTITEDVVLDYYSHSTVEVGDGPAPSSVSAAVAKGS

SEQ ID NO: 308 - protein, 277 aa, Huperzia phlegmaria
MAFVIKVKPGNVNATGNSQHVITDADVKSFGIHDSALKDAVTKYFGRWPTDAYLKSPTPWNDLYKTYGWPQVQIVLKVQSSSITEASSKPVILQYQNFINKSNEEATYTANMSRQKNNSASHTWSNQHTLKVEQKIKYEINFGVNVGGETTLSYQYAFGESGRKTTTTTLSSGSGVTVKVGPHKTKHAILRASEGQMKVRIVYVAHLTGSTAVNYYPTYKGHHFYSLDIAGVMSAGGISSSKTITEDVVLDYYSHSTVEVGDGPAPLSVSAAVAKGS

SEQ ID NO: 309 - protein, 277 aa, Huperzia phlegmaria
MAFVIKVKPGNVNATGNSQHVITDADVKSFGIHDSALKDAVTKYFGRWPTDAYLKSPTPWNDLYKTYGWPQVQIVLKVQSSSITEASSKPVILQYQNFINKSNEEATYTANMSRQKNNSASHTWSNQHTLKVEQKIKYEINFGVNVGGETTLSYQYAFGESGRKTTTTTLSSGSGATVKVGPHKTKHAILRASEGQMKVRIVYVAHLTGSTAVNYYPTYKGHHFYSLDIAGVMSAGGISSSKTITEDVVLDYYSHSTVEVGDGPAPLSVSAAVAKGS

SEQ ID NO: 310 - protein, 277 aa, Huperzia phlegmaria
MAFVIKVKPGNVNATGNSQHVITDADVKSFGIHDSALKDAVTKYFDRWPTDAYLRSPTPWGDLYTKYGWPQVQTVLTVQSSTITEASSKPVILDYQNFVNKSSKEATYTANMSRHKTNSASNTWSNQHTFKIDQKITYKIDFGVNAGGETTLSYQYAFGESGTKTTTTTISSGSGVTVNVGPHQTKHAILRASEGQMKVRIVYVAHLTGSTAVNYYPTYKGHHFYSLDIAAVMSKGGISSSKTITEDILLDYYSHSSVEVGDGPAPSSVSAAVAKGS

SEQ ID NO: 311 - protein, 277 aa, Huperzia phlegmaria
MAFVIKVKPGNVNATGNSQHVITDADVKSFGIHDSALKEAVTKYFDRWPTDAYLRSPTPWGDLYTKYGWPQVQTVLTVQSSTITEASSKPVILDYQNFVNKSSKEATYTANMSRHKTNSASNTWSNQHTFKIDQKITYKIDFGVNAGGETTLSYQYAFGESGTKTTTTTISSGSGVTVNVGPHQTKHAILRASEGQMKVRIVYVAHLTGSTAVNYYPTYKGHHFYSLDIAAVMSKGGISSSKTITEDILLDYYSHSSVEVGDGPAPSSVSAAVAKGS

SEQ ID NO: 312 - protein, 277 aa, Huperzia phlegmaria
MAFLIEVKPGKVNATGNFQHVITDADVKSFGIHDSALKEAVTKYFDRWPTDAYLRSPTPCGDLYTKYGWPQVQTVLTVQSSTITEASSKPVILDYQNFVNKSSKEATYTANMSRHKTNSASNTWSNQHTFKIDQKITYKIDFGVNAGGETTLSYQYAFGESGTKTTTTTISSGSGVTVNVGPHQTKHAILRASEGQMKVRIVYVAHLTGSTAVNYYPTYKGHHFYSLDIAAVMSKGGISSSKTITEDILLDYYSHSSVEVGDGPAPSSVSAAVAKGS

SEQ ID NO: 313 - protein, 277 aa, Huperzia phlegmaria
MAFLIEVKPGKVNATGNFQHVITDADVKSFGIHDSALKEAVTKYFDRWPTDAYLRSPTPWGDLYTKYGWPQVQTVLTVQSSTITEASSKPVILDYQNFVNKSSKEATYTANMSRHKTNSASNTWSNQHTFKIDQKITYKIDFGVNAGGETTLSYQYAFGESGTKTTTTTISSGSGVTVNVGPHQTKHAILRASEGQMKVRIVYVAHLTGSTAVNYYPTYKGHHFYSLDIAAVMSKGGISSSKTITEDILLDYYSHSSVEVGDGPAPSSVSAAVAKGS

SEQ ID NO: 314 - protein, 277 aa, Huperzia phlegmaria
MAFLIEVKPGKVNATGNFQHVITGADVKSFGIHDSALKEAVTKYFDRWPTDAYLRSPTPWGDLYTKYGWPQVQTVLTVQSSTITEASSKPVILDYQNFVNKSSKEATYTANMSRHETNSASNTWSHQHTFKIDQKITYKVDFGVNAGGETTLSYQYAFGESGTKTTTTTISSGSGVTVNVGPHQTKHAILRASEGQMKVRIVYVAHLTGSTAVNYYPTCKGHHFYSLDIAAVMSKGGISSSKTITEDILLDYYSHSSVEVGDGPAPSSVSAAVAKGS

SEQ ID NO: 315 - protein, 277 aa, Huperzia phlegmaria
MAFVIDVEPESLNVTGYSEHVITDDDVDFFGVGDDALKNAVQSYFGRRPNDAYLRSPTPWGDLYSTYGWPQVQTVLQVVSSTVTEESSNPVALAYQNFINDSSEEATYTASMSSQKTNSASNTWTSTNTIKVDQKIQYKINFGVEAGGETDLSYQYAFGESGTKSTTFTISSGSSVTLQVDPHQTKHAILQASQGQKKIRNTYVAYLIGSTAVNYNPTYKGHHFWDMDIAEVMSSGGISNSKIMTEDISLDFYSNSSVEVGDGPAPTSVTLSIAEGS

SEQ ID NO: 316 - protein, 277 aa, Huperzia phlegmaria
MAFVIDVEPESLNVTGYSEHVITDDDVNFFGVGDDALKNAVNSFFGQRPNDAFLRSPTPWGDLYSTYGWPQVQTFLQVVSSTVTEESSNPVTLAYQNFINDSSEEATYTASMSSQKTNSASNTWTSTNTIKVDQKIQYKINFGVEAGGETDLSYQYAFGESGTQSTTFTISSGSSVTVQVDPHQTKHAILKASQGQKKVRITYLASLIGSTAVNYDPTYKGHHFWDMDIGAVMSSGGISNSKIMTEDISLDFFSNSSVEVGDGPAPTSVTLSIAEGS

SEQ ID NO: 317 - protein, 277 aa, Huperzia phlegmaria
MAFVIDVEPESLNVTGYSEHVITDDDVDFFGVGDDALKNAVQSYFGRRPNDAYLRSPTPWGDLYSTYGWPQVQTVLQVVSSTVTEESSNPVALAYQNFINDSSEEATYTASMSSQKANSASNTWTSTNTIKVDQKIQYKINFGVEAGGETDLSYQYAFGESGTKSTTFTISSGSSVTLQVDPHQTKHAILQASQGQKKIRNTYLASLIGSTAVNYDPTYKGHHFWDMDIGAVMSSGGISNSKIMTEDISLDFYSNSSVEVGDGPAPTSVTLSIAEGS

SEQ ID NO: 318 - protein, 277 aa, Huperzia phlegmaria
MAFVIDVEPESLNVTGYSEHVITDDDVNFFGVGDDALKNAVNSFFGQRPNDAFLRSPTPWGDLYSTYGWPQVQTVLQVVSSTVTEESSNPVALAYQNFINDSSEEATYTASMSSQKTNSASNNWTATNTIKVDQKIQYKINFGVEAGGETDLSYQYAFGESGTQSTTFTISSGSSVTVQVDPHQTKHAILKASQGQKKVRITYLASLIGSTAVNYDPTYKGHHFWDMDIGAVMSSGGISNSKIMTEDISLDFYSNSSVEVGDGPAPTSVTLSIAEGS

SEQ ID NO: 319 - DNA, 32 bp, artificial sequence
  cloning primer
catcatatgtctattcaaatcgacatcgagcc

SEQ ID NO: 320 - DNA, 32 bp, artificial sequence; identical to SEQ ID NO: 319
  cloning primer

SEQ ID NO: 321 - DNA, 24 bp, artificial sequence
  6x Histidine purification tag
ctcgagcaccaccaccaccaccac

SEQ ID NO: 322 - protein, 8 aa, artificial sequence
  6x Histidine purification tag
LEHHHHHH

SEQ ID NO: 323 - DNA, 36 bp, artificial sequence
  10x Histidine purification tag
ggatcccaccatcaccatcaccatcaccatcaccat

SEQ ID NO: 324 - protein, 12 aa, artificial sequence
  10x Histidine purification tag
GSHHHHHHHHHH

SEQ ID NO: 325 - protein, 5 aa, Artificial Sequence
  Fusion linker
EEKKN

SEQ ID NO: 326 - protein, 280 aa, Huperzia carriata
MAFVIDVQPQSLNATGSSKHVITDDDVNSFGIYDNALKDAVESYFGQWPNDAFLRSPTPWGDLYKTYGWRQVETVLQVQSSTVTEDSSKPVALAYQNFINDSDKVATFTANMSCQKTNSASNTWTHTSTIKVAENIQYNINFGVEAGGGTDLSYQYEFGKSGTESTSVTITSVSSVTVQVDPHQTRHAILKASQGQMKVRITYMASLLGSTAVNYNPTYKGHHFWDLDIGAVMSSAGISNSLILTEDISLDFYSNSSVEVGDGPAPTSVTLSIAKSVVKR

SEQ ID NO: 327 - protein, 275 aa, Huperzia carriata
MAFVIDIKPGKVNATGNSQHVITDADVKSFGIHDSALKNAVTKYFGKWPTDAYLRSPTPWGDLYSTYGWPQVQTVLKVQSSTITGAYSKPVLVDYENFVNNSSEEATYTANMSRQKTDSASNTWSNLHTFKTDQKITYKINFGVNVGGETTLSYQYAFGESGTKTTTTTISSGSRVTVDVGPHQTKHAILSASECQMKVRIVYVAHLTGSTAVNYDPTYKGHHFYGLDIAAVMSAGGISSSKTITEDIVLDYYSHSTVEVGDGPAPSSVVSAVAK

SEQ ID NO: 328 - protein, 275 aa, Huperzia tetratoides
MAFVIEIKPERVNATGYTKHVITDADVKSFGIHDSALKDAVKKYFGKSPNDAYLKSPTPWGDLYTKYGWPQVQTVLKVQSSTITEASSKPVILDYQNFVNKSSIEATYTANMSRQKTNSASQTWSHQHTLKIEQKIKYDIDFGVHAGGETALSYQYAFGEGGTKSTTTTLSSGSGVTVKVGPHKAKHAILRASEGRIKVSIVYVAYLTGFTAVNYNPPYKGHHFYGLDIGGVMSGGGISNSKTIIEDIVLDYFSHSTVEVGDGPAPSSVSAAVAK

SEQ ID NO: 329 - protein, 275 aa, Huperzia squarrosa; identical to SEQ ID NO: 328

SEQ ID NO: 330 - protein, 275 aa, Huperzia squarrosa
MAFVIDIKPGKVNATGNSQHVITDADVKSFGIHDSALKDAVKKYFGKSPNDAYLKSPTPWGDLYTKYGWPQVQTVLKVQSSTITEASSKPVILDYQNFVNKSSIEATYTANMSRQKTNSASNTWSNQHTFKIDQKITYKIDFGVNVGGETTLSYQYAFGESGTKTTATTISSGSGVIVKVGPHQTKHAILRASEGQMKVRIVYVAHLTGSTAVNYYPTYKGHHFYSLDIAGVMNKGGISSSKTITEDVVLDYYSHSTVEVGDGPAPSSVSAAVAK

SEQ ID NO: 331 - protein, 302 aa, Huperzia obtusifolia
MSIQIDIEPGNVRVSGSSRHIITDADVRTFGLNDNALKNAVLAHFERRPNDAFLRSPTPWGDLYTTYGWPQVQTVLAVRSSQILEETTRPVMLAYQNFVNNTNTEATYTANMSRAMTNSSSNTWSNTHSLAFEQKIKYGINFGITAQGETTLSYEFSFGQSGTESVSTTISTGAGVSVVVGPHRTKHAILSASEGRMRVRIHYEAYLTGSTAVNYNPRHRGHHFWGLGIAGVMRSGNISNTRTITEDISLQSYSNGSVVLGEGPAPISLVEEVKTLNEKATAPIPVIESTEPLEEEEEEKKE

SEQ ID NO: 332 - protein, 275 aa, Huperzia obtusifolia
MSIQIDIEPGNVRVSGSSRHIITDADVRTFGLNDNALKNAVLAHFERRPNDAFLRSPTPWGDLYKSYGWQQVLTVLQAQSSTVTEESSTPVALAYQNFINDSSEEATYTASMSSQKTNSASNTWTSTNTIKVDQKIQYKINFGVEAGGETDLSYQYTFGESGTQSTTFTISSGSSVTLQVDPHQTKHAILKASQGQKKIRNTYQAYLTGSTAVNYNPTYKGHHFWDLDIGGVMSSGGISNNKIMTEDISLDFYSNGSVEVGDGPAPTSVTLSIAE

SEQ ID NO: 333 - protein, 281 aa, Huperzia obtusifolia
MSIQIDIEPGNVRVSGSSRHIITDADVGTFGLNDNALKNAVQARNGRRPNDVFLRSPTPWGDLFISYNWAQTQTVLVVRSSTILEESTRPVMLAFQNFVNNTNTEATFTANMSREVTNSSSNTWSNTHSFSFEQTITYRISFGITAGGETTLGYEHSFGQSGTTSMSTTLGTGAGVSVVVGPQRTKHAILSASEGRMRVRISYEVYLTGNAALNYNPRFEGHHFWRLGIAELMRYGNINGTRTITEDISLESYSNGSVVLGEGPAPISVVQAVESLEKEKK

SEQ ID NO: 334 - protein, 302 aa, Huperzia obtusifolia
MAFVIDIEPESLNVTGYSEHVITDDDVDFFGVGDYALKNAVNSYFGQWPNDAFLRSPTPWGDLYTTYGWPQVQTVLAVRSSQILEETTRPVMLAYQNFVNNTNTEATYTANMSRAMTNSSSNTWSNTHSLAFEQKIKYGINFGITAQGETTLSYEFSFGQSGTESVSTTISTGAGVSVVVGPHRTKHAILSASEGRMRVRIHYEAYLTGSTAVNYNPRHRGHHFWGLGIAGVMRSGNISNTRTITEDISLQSYSNGSVVLGEGPAPISLVEEVKTLNEKATAPIPVIESTEPLEEEEEEKKE

SEQ ID NO: 335 - protein, 275 aa, Huperzia obtusifolia
MAFLIEVKPGKVNATGNFQHVITDADVKSFGIHDSALKEAVTKYFGRWPTDAYLRSPTPWGDLYKSYGWQQVLTVLQAQSSTVTEESSTPVALAYQNFINDSSEEATYTASMSSQKTNSASNTWTSTNTIKVDQKIQYKINFGVEAGGGSELSYQYAFGESGTQSTSVTISSGSSVSVQVDPHQTKHAILQASQGQKKVRITYAASLTGSTAVNYDPTYKGHHFWDLDIGAVMSSGGICNSKTMTLDIALDFYSNSSVEVGDGPAPSSVSAAVAK

SEQ ID NO: 336 - protein, 275 aa, Huperzia obtusifolia
MAFLIEVKPGKVNATGNFQHVITDADVKSFGIHDSALKEAVTKYFGRWPTDAYLRSPTPWGDLYTKYGWPQVQTVLTVQSSTITEASSKPVILDYQNFVNKSSKEATYTANMSRHKTNSASNTWSNQHTFKIDQKITYKINFGVDAGGETTLSYQYAFGESGTKTTTTTISSGSGVTVNVGPHQTKHAILRASEGQMKVRIVYVAHLTGSTAVNYYPTYKGHHFYSLDIAAVMSKGGISSSKTITEDILLDYYSHSSVEVGDGPAPSSVSAAVAK

SEQ ID NO: 337 - protein, 289 aa, Huperzia obtusifolia
MSIEIDIEPGSVRVSGSFRHIITDADVGTFGLHDDALKNAVLAHNGRRPNDAFLRSPTPWGDLYTTYGWAQVQTVLVVRSSTILEESSRPTALAYQNFVNNTSSEATFAAHLSREMTNSSSNTWSNTHSIRFEQTITYKINFGITAGGETSLGYESAFGQSGTHQTSTTITSGASVSVVVLPHTTKHAILTASEGRMRVRITYEVYLTGSTAVNYNPRHNGHHFWGLGISGVMRSGNISNTRTITEDVTLQSYSNGNIVLGDGPAPSPVVEAVETLEKEKEKEKEKEKE

SEQ ID NO: 338 - protein, 281 aa, Huperzia lucidula
MAISIDIDVDTGKVSATGSSRHIITDADVQSFGIYDSALKNAVQAYFGKRPNDAYLKSPTPWGDLYKSYGWPQVQTVLVVQSSTITEDSSKPVMLDYQNFVNNSSTGEATYTANMSREVTNSASNTWSNTHSLNFEQKIEYEIDFGVHVGGETSLSYQATFGESGTNSTTTTLSSGTGVTVTVPPHQTKHAILSASQGRMKVQIVYQAYLTGGTAVNYDPTYNGHHFWWMPIDGVMSSGNITNQKTITEDIELEYCCNSQVEVGDGPAPASVSASAAASKK

SEQ ID NO: 339 - protein, 275 aa, Huperzia lucidula
MAISIDIKPGNVSVTGSSRHVITDADVQSFGIFDNALKNAVQAYFGQRPNDAYLKSPTPWGDLYSTYNWAQVQTVLVVRSSTITEDTSKPVMLDYQNFVNNSSNEATYTANMSRQKTNSASNTWSNTHSIKIEQKIEYKIDFGVSVGGETSLSYEYAFGESGTQSTTTTLTSGSGVSVTVPAQQTKHAILSASQGQMKVRIVYEAYLIGSTAVNYNPKYNGHHFYALGIGAVMSSGNISNNKTITEDIVLEYYSKSSVVVGDGPVPTSVAALVAK

SEQ ID NO: 340 - protein, 278 aa, Huperzia lucidula
MAISIDIDVDTGKVSATGSSRHVITDDEVQSFGLNDNALKNAVQAYFGQRPNDAYLKSPTPWGDLYKSYGWPQVQTVLVVQSSTITEEDSHPVMLDYQNFVNNSSTGEATYTANMSRQKTNSASNTWSNTHSLKFEQRIEYEIDFGVHVGGETSLSYQATFGESGTNSTTTTLSSGTGVTVTVPPHQTKHAILSASQGQMKVRIVYEAYLIGSTAVNYNPTYKGHHFWWLGIGGVMSSGNISNNKTITEDIVLEYYSKSSVVVGDGPVPTSVAALVAK

SEQ ID NO: 341 - protein, 277 aa, Diphasiastrum tristachyum
MGISIDIKAGKVTVTGSLRHVITDAEVESFGIGDSALKNAVQAYFGRRPNDAYLKSPTPWNDLYKSYGWSQVQTVLAVQSSTITEEGSQPVMLSYQNFVNNDSQEATFTANMSSQRSNSVSASWSNTHTVKFDQKINYSIEFGAKVGGESSLSYQYAFGESGSKSVTTTLSSGSGVTVKVPPHQTKHAILTASNGYMKVRIVYEAHLTGVTAINCDPPYQGHHFWSLDIGGVMSSGSITNKITITEDIALDYYSNSTVEVGDGPAPQLLVKSIDHGA

SEQ ID NO: 342 - protein, 281 aa, Diphasiastrum tristachyum
MAISIDIKDGKVTAFGSLRHVITDAEVKSFGIHDYALKNAVKAEFGKQPNDAYLKSPTPWNDLYKTYGWLQVQTVLVVRSSTITENNSQPVTLDYQDFVNNSNEEATYTANMSCQKTNSASTNWSNTHSIKFEQKINYSIEFGEIAKAKLGGETSLSYQYAFGESGSKSVTTTLSSGSGVTVKVPPHQTKHAILTASNGYMKVRIVYEAHLTGVTAINCDPPYQGHHFWSLDIGGVMSSGSITNKITITEDIALDYYSNSTVEVGDGPAPQLLVKSIDHGA

SEQ ID NO: 343 - protein, 269 aa, Huperzia carinata
MAFRIAIKPGNVNATGNSHHVITDADVKSFGIHDSALKDAVTKYFGRWPTDAYLKSPTPWNDLYTTYGWPQVQTVLKVQSSTITGAYSNPVLVDYENFVNSSCEKATYTANMSRQKTNSASHTWSNQHTLKIEQKIKYEINFGVNVGGETTLSYQYAFGESGTKTTTTTLSSGSGVTVKVGPHKTKHAILRASEGQMKVRIVYVAHLTGSTAVNYYPTYKGHHFYGLDIAGVMSAGGISNRKTITEDVVLDYYSHSTVEVGMDQRHRQC

SEQ ID NO: 344 - protein, 275 aa, Huperzia salvinioides
MAFVIAIKPGKVNATGNSQHVITDADVKSFGIHDSALKDAVSKYFGRWPTDAYLKSPTPWGDLYETYGWAQVQTVLKVQSSTITEASSKPVLLDYQNFVNKSCEEATYTANMSRQKTNSASHTWSNQHTFKIEQKIKYDINFGVDVGGETTLSYQYAFGESGTKTTTTTLSSGSGVIVKVGPHQTKHAILRASEGQMKVRIVYVAHLTGSTAVNYNPTYKGHHFYSLDIAAVMSKGGICSSKTITEDVVLGYYSHSTVEVGDGPAPSSVLAAVAK

SEQ ID NO: 345 - protein, 275 aa, Lycopodium species
MAFVIDIKPGKVNATGNSQHVITDADVKSFGIHDSALKDAVKKYFGKSPNDAYLKSFTPWGDLYTKYGWPQVQTVLKVQSSTITEASSKPVILDYQNFVNKSGKEATYTASMSRQKTNSASHSWSNQHTFKIDQKIKYEIDFGVNVGGETTLSYQYAFGESGTKTTTTTISSGSGVIVNVGPHQTKHAILRASEGQMRVRIVYVAHLTGSTAVNYYPTYKGHHFYSLDIAGVMSKGGISSSKTITEDVVLDYYSHSTVEVGDGPAPSSVSAAVAK

SEQ ID NO: 346 - DNA, 843 bp, Huperzia lucidula
atggctatttctatcgacatcgatgtcgatactggcaaggtgagtgccaccggaagttctcggcatatcattaccgatgccgatgtgcaatctttcggcatctatgacagcgccctcaagaatgccgtccaagcatacttcggcaaaaggcccaatgacgcctacctcaaaagccccacgccttggggtgatctctacaaatcttacggttggccgcaggtccagaccgtgcttgtggtccagagctccacaattactgaggactcctccaaaccggtgatgcttgattaccagaattttgttaacaattccagcactggcgaagccacttatacagctaacatgtcccgtgaggtgaccaattcggcttctaacacctggtccaatacacactccctcaactttgagcagaagatcgaatacgagatcgacttcggggttcatgttggcggagaaactagcttgtcctatcaggctacatttggtgagagcgggaccaatagcacgaccaccactctcagttcgggaacaggagtgactgtgacggtacccccgcaccaaaccaagcacgcaatccttagtgcctcccaaggccggatgaaagtccagatcgtttatcaggcatatctgaccggaggtaccgcggtcaattacgatcccacttacaacggacatcacttctggtggatgcctatcgatggtgtcatgagcagcggcaacattaccaaccaaaagactatcactgaggacattgagttggagtactgctgtaactcccaggtcgaggttggggacggaccagcgccagcatcagtgtcagcgtcggcagcggcgtcgaagaaa

SEQ ID NO: 347 - DNA, 825 bp, Huperzia lucidula
atggctatttcaatcgacatcaagcctggcaacgtgagtgtcaccggaagttctcggcatgtcattacggatgccgatgtgcaatctttcggcatctttgacaacgccctcaagaatgccgttcaagcatacttcggccaaaggcccaatgacgcctacctcaaaagccccacgccttggggtgatctctacagcacttataattgggcgcaggtccagaccgtgcttgtggtccggagctccacaattactgaggacacctccaaaccggtgatgcttgattaccagaattttgtgaacaattccagcaacgaagcaacttatacagctaacatgtcccgtcagaagaccaattcggcttctaacacctggtccaatacacactccatcaagattgagcagaagatcgaatacaagatcgacttcggggttagtgttggcggagaaactagcctgtcctatgagtatgcatttggtgagagcgggacacaatccacgaccaccactctcacttcagggtcaggagtgagtgtgacggtacccgcgcagcaaaccaagcacgcaatccttagcgcctcccaaggccagatgaaagtccggatcgtgtatgaggcgtatctgatcggatctaccgcggtcaattacaatcccaagtacaatggacatcacttctacgctttgggtatcggtgccgtcatgagcagcggcaacattagcaacaacaagactatcactgaggacattgtgttggagtactactcgaaatccagcgtcgtggttggggacggaccagtgccaacgtcagtggcagcgttagtagcgaaa

SEQ ID NO: 348 - DNA, 834 bp, Huperzia lucidula
atggctatttctatcgacatcgatgtcgatactggcaaggtgagtgccaccggaagttctcggcatgtgattaccgatgacgaagtgcaatctttcggccttaatgacaacgccctcaagaatgccgttcaagcatacttcggccaaaggcccaatgacgcctacctcaaaagccccacgccttggggtgatctctacaaatcttacggttggccgcaggtccagaccgtgcttgtggtccagagctccacaattactgaggaggactcccatccagtgatgcttgattaccagaattttgttaacaattccagcactggcgaagccacttatacagctaacatgtcccgtcagaagaccaattcggcttctaacacctggtccaatacacactccctcaagtttgagcagaggatcgaatacgagatcgacttcggggttcatgttggcggagaaactagcttgtcctatcaggctacatttggtgagagcgggaccaatagcacgaccaccactctcagttcgggaacaggagtgactgtgacggtacccccgcaccaaaccaagcacgcaatccttagcgcctcccaaggccagatgaaagtccggatcgtgtatgaggcgtatctgatcggatctaccgcggtcaattacaatcccacttacaagggacatcacttctggtggttgggtatcggtggtgtcatgagcagcggcaacattagcaacaacaagactatcactgaggacattgtgttggagtactactcgaaatccagcgtcgtggttggggacggaccagtgccaacgtcagtggcagcgttagtagcgaaa

SEQ ID NO: 349 - DNA, 831 bp, Diphasiastrum tristachyum
atgggtatttcaatcgacatcaaggctggcaaagtgactgtcaccggaagtcttcggcatgtgattaccgatgccgaagtggaatctttcggcatcggtgactccgccctcaagaatgccgtccaggcttacttcggcagacggcccaatgatgcctacctcaaaagccccaccccttggaatgatctctacaagagttacggttggtcgcaggtccagaccgtgcttgcggtccagagctccacaatcactgaggagggttcccaaccggtaatgcttagttaccagaattttgttaacaatgacagccaagaagctacttttacagctaacatgtcctcgcagcgcagcaattcggtttctgcaagctggtccaatacgcacaccgtaaagtttgatcagaagatcaactactcgatcgagtttggggctaaagttggcggagaaagtagcttgtcctatcagtatgcatttggtgagagcgggtcaaaatccgtgaccaccactctaagttcagggtcaggagtgactgtgaaggtacccccgcatcaaaccaagcacgcaatccttaccgcctccaatggctatatgaaagtccggatcgtttatgaagcccatctaaccggagttaccgcaatcaattgcgatcctccgtaccagggacatcacttctggtctttggatatcggtggcgtcatgagcagcggctccattaccaacaaaattactatcactgaggacattgcgttggactactactccaactccacggtcgaggttggggatggaccagcgccacagctcctggtgaagtcgatcgatcatggagct

SEQ ID NO: 350 - DNA, 843 bp, Diphasiastrum tristachyum
atggctatttcaatcgacatcaaggatggcaaggtgactgccttcggaagtcttcggcatgtgattaccgatgccgaagtgaaatctttcggcatccacgactacgccctcaagaatgccgtcaaggctgagttcgggaaacagcccaatgatgcctacctcaaaagcccaacgccttggaatgatctctacaagacttacggttggttgcaggtccagaccgtgcttgtggtccggagctccacaatcactgagaataattcccagccggtgacgcttgactaccaggattttgttaacaatagcaacgaagaagctacttatacagctaacatgtcctgtcagaaaaccaattcggcttctacaaactggtccaatacgcactccatcaagtttgagcaaaagatcaactactcgatcgagttcggagaaattgctaaggctaaacttggcggagaaactagcttgtcctatcagtatgcatttggtgagagcgggtcaaaatccgtgaccaccactctaagttcagggtcaggagtgactgtgaaggtacccccgcatcaaaccaagcacgcaatccttaccgcctccaatggctatatgaaagtccggatcgtttatgaagcccatctaaccggagttaccgcaatcaattgcgatcctccgtaccagggacatcacttctggtctttggatatcggtggcgtcatgagcagcggctccattaccaacaaaattactatcactgaggacattgcgttggactactactccaactccacggtcgaggttggggatggaccagcgccacagctcctggtgaagtcgatcgatcatggagct

SEQ ID NO: 351 - DNA, 825 bp, Huperzia obtusifolia
atggcttttttgatcgaagtcaagcccggaaaagtgaatgccactggaaattttcagcatgtcattacggatgccgatgtgaaatccttcggcatccatgacagcgccctcaaggaggccgtcacaaaatacttcggtagatggcctactgacgcctacctcagaagccccacgccttggggtgatctctacaaatcttacggttggcagcaggtactgaccgtgcttcaagcccagagctccacagtcactgaggaatcctccaccccagtggcgcttgcttaccagaattttatcaacgattcgagtgaagaagccacttatactgctagcatgtcgtcccagaagaccaattctgcttccaacacctggacctccacgaacaccatcaaggttgatcagaagattcaatacaagatcaacttcggggttgaagctggcggaggatctgagttgtcttatcaatacgcgtttggcgagagcgggacacaatccactagcgtcactataagttcaggttcatcagtgagtgtgcaggtagacccgcatcaaaccaagcacgcaatccttcaagcctcgcaaggccagaagaaagttcggatcacgtatgcggccagtctgaccggatctactgctgtgaattacgatcctacgtacaaggggcatcacttctgggacctggatatcggtgcggtcatgagcagcggaggcatttgcaacagcaagactatgacgttggacatcgcattggacttctactcgaattccagtgtggaggttggggatggaccagcgccatcgtcagtgtcagcagcagtagccaaa

SEQ ID NO: 352 - DNA, 825 bp, Huperzia obtusifolia
atggcttttttgatcgaagtcaagcccggaaaagtgaatgccactggaaattttcagcatgtcattacggatgccgatgtgaaatccttcggcatccatgacagcgccctcaaggaggccgtcacaaaatacttcggtagatggcctactgacgcctacctcagaagccccacgccttggggtgatctctacaccaaatacggttggccgcaggttcagaccgtgctgacggtccagagttctacaattactgaggcatcctccaaaccagtgatacttgattaccagaattttgttaacaaatccagtaaagaagccacttatacagccaacatgtctcgccataagaccaattcggcttccaacacctggtccaaccagcacaccttcaagattgatcagaagattacatacaagatcaacttcggggttgatgctgggggagaaactaccctgtcctatcagtatgcatttggcgagagtgggacaaaaaccacgaccaccactatctcttcagggtcaggagtgactgtgaacgttggcccgcatcaaaccaagcacgcaatccttcgcgcctcggaaggccagatgaaagtccgcattgtttacgttgctcatctgacggggtctactgccgtgaattactatcccacgtacaaggggcatcacttctacagcttggatatcgccgccgtcatgagcaaaggaggcatcagcagcagcaagactataacagaagacattttgctggactactactcgcattccagtgtggaggttggggatggaccagcgccatcgtcagtgtcagcagcagtagccaaa

SEQ ID NO: 353 - DNA, 807 bp, Huperzia carinata
atggcttttcggatcgccatcaagcccggaaatgtgaatgccactggaaactctcaccatgtcattacagatgccgatgtgaaatcctttggcatccatgacagcgccctcaaggatgccgtcacaaaatacttcggcagatggcccactgacgcctacctcaaaagccccacaccttggaatgatctctataccacttacggttggccgcaggttcagaccgtgcttaaggtccagagttccacaattactggggcatactcgaacccagtgctagttgattacgagaattttgtcaacagttcctgtgaaaaagccacttatacagctaacatgtctcgccagaagaccaattcggcttcccatacctggtccaaccagcacaccttaaagattgagcagaagatcaagtacgaaatcaacttcggggttaatgttggaggagaaactaccctgtcctatcagtatgcattcggcgagagcgggacaaaaactacgaccaccactctctcttcagggtccggagtgactgtgaaggtaggcccgcataaaaccaagcatgcaatccttcgcgcctcggaaggccagatgaaagtccgcattgtttacgtggctcatctgacggggtctaccgctgtgaattactatcccacgtacaaggggcatcacttctacggcttggatatcgctggcgtcatgagcgcaggaggcattagcaacagaaagactataacagaagacgttgtgctggactactactcgcattccactgtggaggttgggatggaccagcgccatcgtcagtgt

SEQ ID NO: 354 - DNA, 825 bp, Huperzia salvinioides
atggcttttgtgattgccatcaagcccggaaaagtgaatgccactggaaattctcagcatgtcattacggatgccgatgtgaaatccttcggcatccatgacagcgccctcaaggatgccgtctcaaaatacttcggcagatggcccactgacgcctacctcaaaagccccacgccttggggtgacctctatgaaacttacggttgggcgcaggttcagacagtgcttaaggtccagagctccacgattactgaggcatcctccaagccagtgctacttgattaccagaattttgttaacaaatcttgtgaagaagccacttatacagctaacatgtctcgccagaagaccaattcggcatcccacacctggtccaaccagcacaccttcaaaattgaacagaagatcaaatacgacatcaatttcggggttgatgttgggggagaaactaccctgtcctatcaatatgcatttggcgagagtgggacaaaaaccacgaccaccactctctcttcagggtcaggagtaattgtgaaggtaggcccgcatcaaaccaagcatgcaatccttcgcgcctcggaaggccagatgaaagtccgcattgtttacgttgctcatctgacggggtctactgccgtgaattacaatcccacgtacaaggggcatcacttctacagcttggatatcgctgccgtcatgagcaaaggaggcatttgcagcagcaagactataacagaagacgtggtgctgggctactactcacattccactgtggaggttggggatggaccagcgccatcgtcagtgttagcagcagtggccaaa

SEQ ID NO: 355 - DNA, 840 bp, Huperzia carriata
atggctttcgtaatcgacgtccagcctcaaagtttgaatgccaccggatcttctaagcatgtcatcacggatgacgatgtgaattccttcggcatttacgacaacgccctcaaggatgctgtcgagtcatatttcggccaatggccaaacgacgccttcctcagaagccccacgccttggggtgatctctacaaaacttacggttggcggcaggtagagaccgtgcttcaagtccagagctccacggtcaccgaggactcctccaaaccagtggcgcttgcttaccagaattttatcaacgattccgataaagtagccacatttaccgctaacatgtcttgccagaagaccaattcggcttccaacacctggactcacacgagcaccatcaaggttgctgagaatattcaatacaatatcaacttcggggttgaagctggcggaggaactgacttgtcttaccaatacgagtttggcaagagcgggacagaatccacgagcgtcactataacttcagtttcatcagtgactgtgcaggtagacccgcatcaaaccaggcacgcaatccttaaagcctcgcaaggccagatgaaagttcggatcacgtatatggctagtctacttggatctacagccgtgaattacaatcctacgtacaagggacatcacttctgggacttggatatcggtgcagtcatgagcagcgcaggcattagcaacagcttaattttgacagaggacatctcattggacttctactcgaattccagtgtggaggttggggatggaccagcgccaacgtcagtgacactgtcaatagccaaatcagttgtcaagcgt

SEQ ID NO: 356 - DNA, 825 bp, Huperzia carriata
atggcttttgtgatcgacatcaagcccggaaaagtgaatgccactggaaattctcagcatgtcattacagatgccgatgtgaaatcctttggcatccatgacagcgccctcaagaatgccgtcacaaaatacttcggcaaatggcccactgacgcctacctcagaagccccacgccttggggtgacctctacagcacttacggttggccgcaggttcagaccgtgcttaaggtccagagttccacaattactggggcatactcgaaaccagtgctagttgactacgagaattttgtcaacaattccagtgaagaagccacttatacagctaacatgtctcgccagaagaccgattcggcttccaacacctggtccaacctgcacaccttcaagactgatcagaagatcacatacaagatcaacttcggggttaatgttgggggagaaactaccctgtcctatcagtatgcatttggggagagtgggacaaaaaccacgaccaccactatctcttcagggtcacgagtaactgtggacgtaggcccgcatcaaaccaagcacgcaatccttagcgcctcggaatgccagatgaaagtccgcatcgtttatgtcgctcatctgacggggtctactgctgtgaattacgatcccacgtacaaggggcatcacttctacggcttggatatcgctgcggtcatgagcgcaggaggcatcagcagcagcaagactataacagaagacattgtgctggactactactcgcattccactgtggaggttggggatgggccagcgccatcgtcagtagtatcggctgtagcgaaa

SEQ ID NO: 357 - DNA, 825 bp, Huperzia tetratoides
atggcttttctgatcgacatgaagcccggaaaagtgaatgccactggaaattctgagcatgtcattacggattcagatgttaaatatttcggcatccatgacagcgccctcaaggatgccgtcacaaaatacttcggcagatggcccactgacgcctacctcaaaagccccacgccttggggtgacctctacaccaaatacggttggccgcaggttcagaccgcgcttaaggtccagagttccacaattactgaggcatcctccaaaccagtgacgctcgattaccagaattttgttaacaattccagtgaagaagccacttatacagctaacatgtctcgccagaagaccaattcggcttccaacagctggtccaacctgcacaccttcaaaattgatcagaagattacatacaagatcaacttcggagttaatgttgggggagaaactagcctgtcctatcagtatgcttttggcaaaagtgggacagaaaccacgaccgccactatctcttcagggtcaggagtgattgtgaaggtaggcccgcatcagaccaagcacgcaatccttcgcgcctcggaaggccagatgaaagtccgcattgtttacgtggctcatctgacggggtctactgcagtgaattactatccgacgtacaaggggcatcacttctacagcttggacatcgctggcgtcatgagcaaaggaggcattggcaacagcaagactataacagaagacgttgtgttggactactactcccattccactgtggaggttggggatggaccagcgccatcgtcagtgttagcagcagtagccaaa

SEQ ID NO: 358 - DNA, 825 bp, Huperzia squarrosa
atggcttttgtgatcgagatcaagcccgaaagagtgaatgccactggatatactaagcatgtcattacggatgccgatgtgaaatcctttggcatccatgacagcgccctcaaggatgccgtaaagaaatacttcggcaaaagtcccaatgacgcttacctcaaaagccccacgccatggggtgacctctacaccaaatacggttggccgcaggttcagaccgtgcttaaggtccagagttccacaattactgaggcatcctccaaaccagtgatcctcgattaccagaattttgttaacaaatccagtatagaagccacttatacagctaacatgtctcgccagaagactaattcggcttcccagacctggtcgcaccagcacaccttaaagattgagcagaagatcaaatacgacatcgacttcggggttcatgctgggggagaaactgccctgtcctatcagtatgcatttggcgagggtgggacaaaaagcacgaccaccactctctcttcagggtcaggagtgactgtgaaagtaggcccgcataaagccaagcacgcaatcctccgcgcctcggaaggccggatcaaagtcagcatcgtttacgtggcttatctgaccggatttactgctgtgaattacaatcccccgtacaaggggcatcacttctacggcttggatatcggtggcgtcatgagcggaggaggcattagcaacagcaagactataatagaagacattgtgttggactacttctcgcattccactgtggaggttggggatggaccagcgccatcgtcagtgtcagcagcagtagcaaaa

SEQ ID NO: 359 - DNA, 825 bp, Huperzia squarrosa
atggcttttgtgatcgacatcaaacccggaaaagtgaatgccactggaaattctcagcatgtcattaccgatgcggatgtgaaatccttcggcatccatgacagcgccctcaaggatgccgtaaagaaatacttcggcaaaagtcccaatgacgcttacctcaaaagccccacgccatggggtgacctctacaccaaatacggttggccgcaggttcagaccgtgcttaaggtccagagttccacaattactgaggcatcctccaaaccagtgatcctcgattaccagaattttgttaacaaatccagtatagaagccacttatacagctaacatgtctcgccagaagaccaattcggcttccaatacctggtccaaccagcacaccttcaagattgatcagaagattacatacaagatcgacttcggagttaatgtcgggggagaaactaccctgtcctatcagtatgcatttggcgaaagtgggacaaaaaccacggccaccactatctcttcaggatcaggagtgattgtgaaggtaggcccgcatcaaaccaagcacgcaatccttcgcgcctcggaaggccagatgaaagtccgcattgtttacgtggctcatctgacggggtccactgcagtgaattactatcccacgtacaaggggcatcacttctacagcttggatatcgctggcgtcatgaacaaaggaggcattagcagcagcaagactataacagaagacgttgtgttggactactactcgcattccactgtggaggttggggatggaccagcgccatcgtcagtgtcagcagcagtagcaaaa

SEQ ID NO: 360 - DNA, 906 bp, Huperzia obtusifolia
atgtctattcaaatcgacatcgagcctggcaacgtgcgggtgagtggaagttctcggcatattattaccgatgccgatgtgagaactttcggcctcaatgacaacgccctaaagaatgccgtgctagcacacttcgaaagaaggcccaatgacgccttcctcagaagccccacgccttggggtgatctctataccacttacggttggcctcaggtccagacagtgcttgcggttcggagctcccaaattcttgaggagaccaccagaccggtgatgcttgcttatcagaatttcgtcaacaacaccaacacggaagcaacttatacagctaacatgtctcgtgcgatgacaaattcgtcgtctaacacctggtccaatacacactccttagcatttgaacaaaagatcaaatacggaatcaactttgggattaccgctcaaggagaaactacattgagctatgagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccactatgaagcatatctgacagggtctaccgccgtaaactacaatccccggcacagaggacatcacttctggggtttggggatcgctggagtgatgaggagcggcaacatcagcaacacgagaactatcactgaggacatctcattgcagtcctattccaacggcagcgtcgtgcttggggagggaccagcgccaatttcattggtagaagaagtaaaaacgttgaacgagaaggcgacggcgccaattccagtgatagaatcaacagaaccattggaggaggaggaagaagagaagaaggaa

SEQ ID NO: 361 - DNA, 825 bp, Huperzia obtusifolia
atgtctattcaaatcgacatcgagcctggcaacgtgcgggtgagtggaagttctcggcatattattaccgatgccgatgtgagaactttcggcctcaatgacaacgccctaaagaatgccgtgctagcacacttcgaaagaaggcccaatgacgccttcctcagaagccccacgccttggggtgatctctacaaatcttacggttggcagcaggtactgaccgtgcttcaagcccagagctccacagtcactgaggaatcctccaccccagtggcgcttgcttaccagaattttatcaacgattcgagtgaagaagccacttatactgctagcatgtcgtcccagaagaccaattctgcttccaacacctggacctccacgaacaccatcaaggttgatcagaagattcaatacaagatcaacttcggggttgaagctggcggagaaactgacttgtcttatcagtacacgtttggcgagagcgggacacaatccaccaccttcacaataagttcaggttcatcagtgactttgcaggtagaccctcatcaaaccaagcatgcaatccttaaagcctcgcaaggccagaagaaaattaggaacacgtatcaggcctatctgaccggatctaccgctgtgaattacaatcctacgtacaagggacatcacttctgggacctggatatcggtggggtcatgagcagcggaggcattagcaacaacaagattatgacagaggacatctcattggacttctactcgaatggaagtgtggaggttggggatggaccagcgccaacgtcagtgacattatcaatagctgaa

SEQ ID NO: 362 - DNA, 843 bp, Huperzia obtusifolia
atgtctattcaaatcgacatcgagcctggcaacgtgcgggtgagtggaagttctcggcatattattaccgatgccgatgtgggaactttcggcctcaatgacaacgccctcaagaatgccgtgcaagcacgcaatggcagaaggcccaatgacgtcttcctcagaagtcccacgccctggggtgatctcttcatctcttacaactgggcgcagacccagacagtgcttgtggttcggagctccacaattcttgaggagtccactagaccggtgatgcttgctttccagaatttcgtcaacaataccaacacggaagcaacttttacagctaacatgtcccgtgaggtgaccaattcgtcgtccaacacctggtccaatacgcactccttcagttttgaacagacgatcacatacagaatcagcttcgggattaccgctggcggagaaactacattgggctatgagcattcttttggtcaaagcggtacaacctcgatgagcactactctgggtacaggggcaggagtgagtgtggtagttggcccgcaaagaaccaagcacgcaatccttagcgcctccgaagggcggatgagagtccggatcagttatgaggtgtatctaacggggaatgccgccttgaattacaatcctcggttcgaagggcatcacttctggcgtttggggatcgctgaattgatgagatacggcaacatcaacggcacgaggactatcactgaggatatctcgttggagtcctattccaacggcagcgttgtgcttggcgagggaccagcgccaatttcagtggtacaagcagtagagtcgttggagaaggagaagaaa

SEQ ID NO: 363 - DNA, 906 bp, Huperzia obtusifolia
atggcttttgtaatcgacatcgagcctgaaagtttgaatgtcaccggatattctgagcatgtcatcacggatgacgatgtggatttcttcggcgttggtgactacgcactcaagaacgccgtcaactcatatttcggccaatggcccaatgacgccttcctcagaagccccacgccttggggtgatctctataccacttacggttggcctcaggtccagacagtgcttgcggttcggagctcccaaattcttgaggagaccaccagaccggtgatgcttgcttatcagaatttcgtcaacaacaccaacacggaagcaacttatacagctaacatgtctcgtgcgatgacaaattcgtcgtctaacacctggtccaatacacactccttagcatttgaacaaaagatcaaatacggaatcaactttgggattaccgctcaaggagaaactacattgagctatgagttttcgtttggtcaaagtgggacagagtcggtgagcaccacgatcagtacaggggcaggagtgagtgtggtagttggcccgcaccgaaccaagcacgcaatccttagcgcttcggaagggcggatgagagtccggatccactatgaagcatatctgacagggtctaccgccgtaaactacaatccccggcacagaggacatcacttctggggtttggggatcgctggagtgatgaggagcggcaacatcagcaacacgagaactatcactgaggacatctcattgcagtcctattccaacggcagcgtcgtgcttggggagggaccagcgccaatttcattggtagaagaagtaaaaacgttgaacgagaaggcgacggcgccaattccagtgatagaatcaacagaaccattggaggaggaggaagaagagaagaaggaa

SEQ ID NO: 364 - DNA, 867 bp, Huperzia obtusifolia
atgtctattgaaatcgacattgagcctggcagcgtgcgggtgagtggaagttttcggcatatcattactgatgccgatgtgggaactttcggcctccatgacgacgctctcaagaatgctgtgctagcacacaatggcagaaggcccaatgacgccttcctcagaagccccacaccttggggtgatctctacaccacttacggatgggcgcaggtccaaacagtacttgtggttcggagctccacaattcttgaggagtcctccagaccgacggcgcttgcttaccagaacttcgtcaacaataccagcagcgaagcaacttttgcagctcacttgtcccgtgagatgaccaattcgtcgtctaacacctggtccaatacgcacagcatcagatttgaacagacgatcacttacaaaatcaacttcgggattaccgctggcggagaaacttcgttgggctatgagtctgcgtttggtcaaagcgggacacatcagacgagcaccactattacttcgggagcatcagtgagtgtggtagttctcccgcacacaaccaagcacgcaatccttaccgcctctgaggggcggatgagagtccggatcacgtatgaggtgtatctcacggggtctaccgccgtgaattacaatcctcggcataatggacatcacttctggggtttggggatctctggagtgatgaggagcggcaacatcagcaacacgcggactatcactgaggacgtcacgttgcagtcctattccaacggcaacatcgtgctcggggacggaccggcgccaagtccagtggtagaagcagtagaaacgttggagaaggagaaggagaaggagaaggagaaggagaaggaa

SEQ ID NO: 365 - DNA, 825 bp, Lycopodium species
atggcatttgtgatcgacatcaaacccggaaaagtgaatgccactggaaattctcagcatgtcattacggatgcggatgtgaaatccttcggcatccatgacagcgccctcaaggatgccgtaaagaaatacttcggcaaaagtcccaatgacgcttacctcaaaagcttcacgccatggggtgacctctacaccaaatacggttggccgcaggttcagaccgtgcttaaggtccagagttccactattactgaggcatcctccaaaccagtgatcctcgattaccagaattttgttaacaaatccggtaaagaagccacttatacagctagcatgtctcgccagaagaccaattcggcttcccacagctggtccaaccagcacaccttcaagattgatcagaagatcaaatacgagatcgacttcggggttaatgttgggggagaaactaccctgtcctatcagtatgcatttggcgaaagtgggacaaaaaccacgaccaccactatctcttcagggtcaggagtgattgtgaacgtaggcccgcatcaaaccaagcacgcaattcttcgcgcctcggaaggccagatgagagtccgcattgtttacgtggctcatctgacggggtctactgcagtgaattactatcccacgtacaaggggcatcacttttacagcttggatatcgctggcgtcatgagcaaaggaggcattagcagcagcaagactataacagaagacgttgtgttggactactactcgcattccactgtggaggttggggatggaccagcgccatcgtcagtgtcagcagcagtagcaaaa

SEQ ID NO: 366 - protein, 252 aa, Bacillus thuringiensis
MDVIREYLMFNELSALSSSPESVRSRFSSIYGTNPDGIALNNETYFNAVKPPITAQYGYYCYKNVGTVQYVNRPTDINPNVILAQDTLTNNTNEPFTTTITITGSFTNTSTVTSSTTTGFKFTSKLSIKKVFEIGGEVSFSTTIGTSETTTETITVSKSVTVTVPAQSRRTIQLTAKIAKESADFSAPITVDGYFGANFPKRVGPGGHYFWFNPARDVLNTTSGTLRGTVTNVSSFDFQTIVQPARSLLDEQ

SEQ ID NO: 367 - protein, 424 aa, Aeromonas hydrophila
AEPVYPDQLRLFSLGQGVCGDKYRPVNREEAQSVKSNIVGMMGQWQISGLANGWVIMGPGYNGEIKPGTASNTWCYPTNPVTGEIPTLSALDIPDGDEVDVQWRLVHDSANFIKPTSYLAHYLGYAWVGGNHSQYVGEDMDVTRDGDGWVIRGNNDGGCDGYRCGDKTAIKVSNFAYNLDPDSFKHGDVTQSDRQLVKTVVGWAVNDSDTPQSGYDVTLRGDTATNWSKTNTYGLSEKVTTKNKFKWPLVGETELSIEIAANQSWASQNGGSTTTSLSQSVRPTVPARSKIPVKIELYKADISYPYEFKADVSYDLTLSGFLRWGGNAWYTHPDNRPNWNHTFVIGPYKDKASSIRYQWDKRYIPGEVKWWDWNWTIQQNGLSTMQNNLARVLRPVRAGITGDFSAESQFAGNIEIGAPVPLAA

SEQ ID NO: 368 - protein, 298 aa, Eisenia fetida
GMSAKAAEGYEQIEVDVVAVWKEGYVYENRGSTSVDQKITITKGMKNVNSETRTVTATHSIGSTISTGDAFEIGSVEVSYSHSHQKSQVSMTQTEVYSSKVIEHTITIPPTSKFTRWQLNADVGGAGIEYMYLIDEVTPIGGTQSIPQVITSRAKIIVGRQIILGKTEIRIKHAERKEYMTVVSRKSWPAATLGHSKLFKFVLYEDWGGFRIKTLNTMYSGYEYAYSSDQGGIYFDQGTDNPKQRWAINKSLPLRHGDVVTFMNKYFTRSGLCYDDGPATNVYCLDKREDKWILEVVG

That which is claimed is:

1. A DNA construct comprising a recombinant polynucleotide encoding an insecticidal polypeptide having at least 90% sequence identity to SEQ ID NO: 160 operably linked to a heterologous regulatory element.

2. A transgenic plant comprising the DNA construct of claim 1.

3. A method of inhibiting growth or killing an insect pest or pest population comprising expressing in a plant the polynucleotide of claim 1.

4. A method for controlling pest infestation comprising providing in the diet of the pest the transgenic plant of claim 2 or a part thereof.

5. A method for improving the yield of a crop comprising growing the transgenic plant of claim 2, wherein the yield of the crop is increased in the presence of an insect pest relative to the crop not comprising said transgenic plant.

6. A method of engineering a IPD080 polypeptide to have a modified physical property, the method comprising;

a) providing an amino acid sequence of a IPD080 polypeptide, wherein the IPD080 polypeptide has at least 90% identity to SEQ ID NO: 160;

b) performing rational protein design of the IPD080 polypeptide of step a), using a secondary, tertiary or quaternary structure of the IPD080 polypeptide of SEQ ID NO: 160;

c) identifying regions of the IPD080 polypeptide of step a) to modify;

d) making an amino acid substitution, deletion or insertion in the IPD080 polypeptide of step a) in the region identified in step c); and e) screening and selecting an engineered variants of step d) for the modified physical property; thereby performing rational protein design with a secondary, tertiary or quaternary structure of the IPD080 polypeptide.

* * * * *